US010100093B2

(12) United States Patent
Tam et al.

(10) Patent No.: US 10,100,093 B2
(45) Date of Patent: Oct. 16, 2018

(54) POLYPEPTIDES AND IMMUNIZING COMPOSITIONS CONTAINING *BURKHOLDERIA* POLYPEPTIDES AND METHODS OF USE

(71) Applicant: EPITOPIX LLC, Willmar, MN (US)

(72) Inventors: Patricia Tam, Golden Valley, MN (US); Lisa L. Herron-Olson, Minneapolis, MN (US); Drew M. Catron, Shoreview, MN (US)

(73) Assignee: EPITOPIX LLC, Willmar, MN (US)

( * ) Notice: Subject to any disclaimer, the term of this patent is extended or adjusted under 35 U.S.C. 154(b) by 0 days.

(21) Appl. No.: 14/586,157

(22) Filed: Dec. 30, 2014

(65) Prior Publication Data
US 2015/0191510 A1 Jul. 9, 2015

Related U.S. Application Data

(60) Provisional application No. 61/922,504, filed on Dec. 31, 2013.

(51) Int. Cl.
| | |
|---|---|
| *C07K 1/00* | (2006.01) |
| *C07K 14/195* | (2006.01) |
| *G01N 33/569* | (2006.01) |
| *C07K 16/12* | (2006.01) |
| *A61K 39/104* | (2006.01) |
| *A61K 39/00* | (2006.01) |

(52) U.S. Cl.
CPC .......... *C07K 14/195* (2013.01); *A61K 39/104* (2013.01); *C07K 16/1203* (2013.01); *G01N 33/56911* (2013.01); *A61K 2039/55561* (2013.01); *A61K 2039/55566* (2013.01); *A61K 2039/70* (2013.01); *C07K 2317/33* (2013.01); *G01N 2469/20* (2013.01)

(58) Field of Classification Search
CPC .................................................. C07K 14/195
See application file for complete search history.

(56) References Cited

U.S. PATENT DOCUMENTS

| | | | | |
|---|---|---|---|---|
| 5,135,854 A | * | 8/1992 | MacKay | C12N 9/60 435/254.2 |
| 5,554,372 A | | 9/1996 | Hunter | |
| 6,027,736 A | | 2/2000 | Emery et al. | |
| 2002/0061569 A1 | | 5/2002 | Haselbeck et al. | |
| 2005/0037444 A1 | | 2/2005 | Meinke et al. | |
| 2005/0124540 A1 | * | 6/2005 | Hovanessian | A61K 39/21 424/208.1 |
| 2006/0233824 A1 | | 10/2006 | Emery et al. | |
| 2013/0028933 A1 | * | 1/2013 | Haynes | C07K 14/005 424/210.1 |

FOREIGN PATENT DOCUMENTS

| | | |
|---|---|---|
| WO | WO 96/01620 | 1/1996 |
| WO | WO 01/37810 | 5/2001 |

OTHER PUBLICATIONS

Stone et al (BMC Microbiology vol. 12: 250 pp. 1-8, 2012).*
Boulianne et al., "Production of functional chimaeric mouse/human antibody" Dec. 1984 *Nature*, 312(5995):643-646.
Bruggemann et al., "Production of human antibody repertoires in transgenic mice" Aug. 1997 *Curr. Opin. Biotechnol.*, 8(4):455-458.
Daugherty et al., "Polymerase chain reaction facilitates the cloning, CDR-grafting, and rapid expression of a murine monoclonal antibody directed against the CD18 component of leukocyte integrins" 1991 *Nucleic Acids Res.*, 19(9):2471-2476.
Defense Threat Reduction Agency, "Broad Agency Announcement HDTRA1-09-14-FRCWMD-BAA" Amendment 14 (Sep. 2013), 61 pages.
U.S. Appl. No. 61/922,504, filed Dec. 31, 2013, Tam.
Harlow et al., *Antibodies, A Laboratory Manual*, Cold Spring Harbor Laboratory: Cold Spring Harbor, New York, NY; 1988. Chapter 5 (94 pages).
Hartinger et al., "16-BAC/SDS-PAGE: A Two-dimensional Gel Electrophoresis System Suitable for the Separation of Integral Membrane Proteins" 1996 *Anal Biochem*, 240:126-133.
Jones et al., "Replacing the complementarity-determining regions in a human antibody with those from a mouse" May 1986 *Nature*, 321:522-525.
Lobuglio et al., "Mouse/human chimeric monoclonal antibody in man: Kinetics and immune response" Jun. 1989 *Proc. Natl. Acad. Sci. USA*, 86:4220-4224.
Lonberg et al., "Antigen-specific human antibodies from mice comprising four distinct genetic modifications" Apr. 1994 *Nature*, 368:856-859.
Lonberg et al., "Human antibodies from transgenic mice" 1995 *Int. Rev. Immunol.*, 13(1):65-93.
Macfarlane, "Two dimensional benzyldimethyl-n-hexadecylammonium chloride—sodium dodecyl sulfate preparative polyacrylamide gel electrophoresis: a high capacity high resolution technique for the purification of proteins from complex mixtures." feb. 1989 *Anal Biochem*, 176(2):457-63.
Morrison et al., "Chimeric human antibody molecules: Mouse antigen-binding domains with human constant region domains" Nov. 1984 *Proc. Natl. Acad. Sci. USA*, 81:6851-6855.
Nothwang et al., "Two-dimensional spearation of membrane proteins by 16-BAC-SDS-PAGE" 2009 *Methods Mol. Biol.*, 528:269-77.
Queen et al., "A humanized antibody that binds to the interleukin 2 receptor" Dec. 1989 *Proc. Natl. Acad. Sci. USA*, 86:10029-10033.
Riechmann et al., "Reshaping human antibodies for therapy." Mar. 1988 *Nature*, 332(6162):323-327.

(Continued)

*Primary Examiner* — Albert M Navarro
(74) *Attorney, Agent, or Firm* — Mueting, Raasch & Gebhardt, PA

(57) ABSTRACT

This disclosure provides isolated polypeptides isolatable from a *Burkholderia* spp., compositions that include one or more of the polypeptides, and methods for making and methods for using the polypeptides. This disclosure also provides antibody that specifically binds one or more of the polypeptides isolatable from a *Burkholderia* spp, compositions that include such antibody, and methods for using such antibody.

10 Claims, 10 Drawing Sheets

Specification includes a Sequence Listing.

(56) References Cited

OTHER PUBLICATIONS

Spellberg et al., "The Antifungal Vaccine Derived form the Recombinant N Terminus of Als3p Protects Mice against the Bacterium *Staphylococcus aureus*" Oct. 2008 *Infect. Immun.*, 76(10):4575-4580.
Stranger-Jones et al., "Vaccine assembly from surface proteins of*Staphylococcus aureus.*" Nov. 2006 *Proc. Natl. Acad. Sci.*, 103(45):16942-16947.
Tatusova et al., "BLAST 2 SEQUENCES, a new tool for comparing protein and nucleotide sequences" 1999 *FEMS Microbiol Lett*, 174:247-250.
Tatusova et al., Correction to "BLAST 2 SEQUENCES, a new tool for comparing protein and nucleotide sequences" 1999 *FEMS Microbiol Lett*, 174:247-250.
Taylor et al., "A transgenic mouse that expresses a diversity of human sequence heavy and light chain immunoglobulins" 1992 *Nucleic Acids Res.*, 20(23):6287-6295.
Verhoeyen et al., "Reshaping human antibodies: grafting an antilysozyme activity" Mar. 1988 *Science*, 239(4847):1534-1536.
Westphal et al., *Methods in Carbohydrate Chemistry*, Academic Press: New York, NY; 1965, 5:83-91.
Wilm et al., "Femtomole sequencing of proteins from polyacrylamide gels by nano-electrospray mass spectrometry" Feb. 1996 *Nature*, 379:466-469.
Nilsson, "Inert carriers for Immunization" 1992 *Res Immunol* 143(5): 553-557.

* cited by examiner

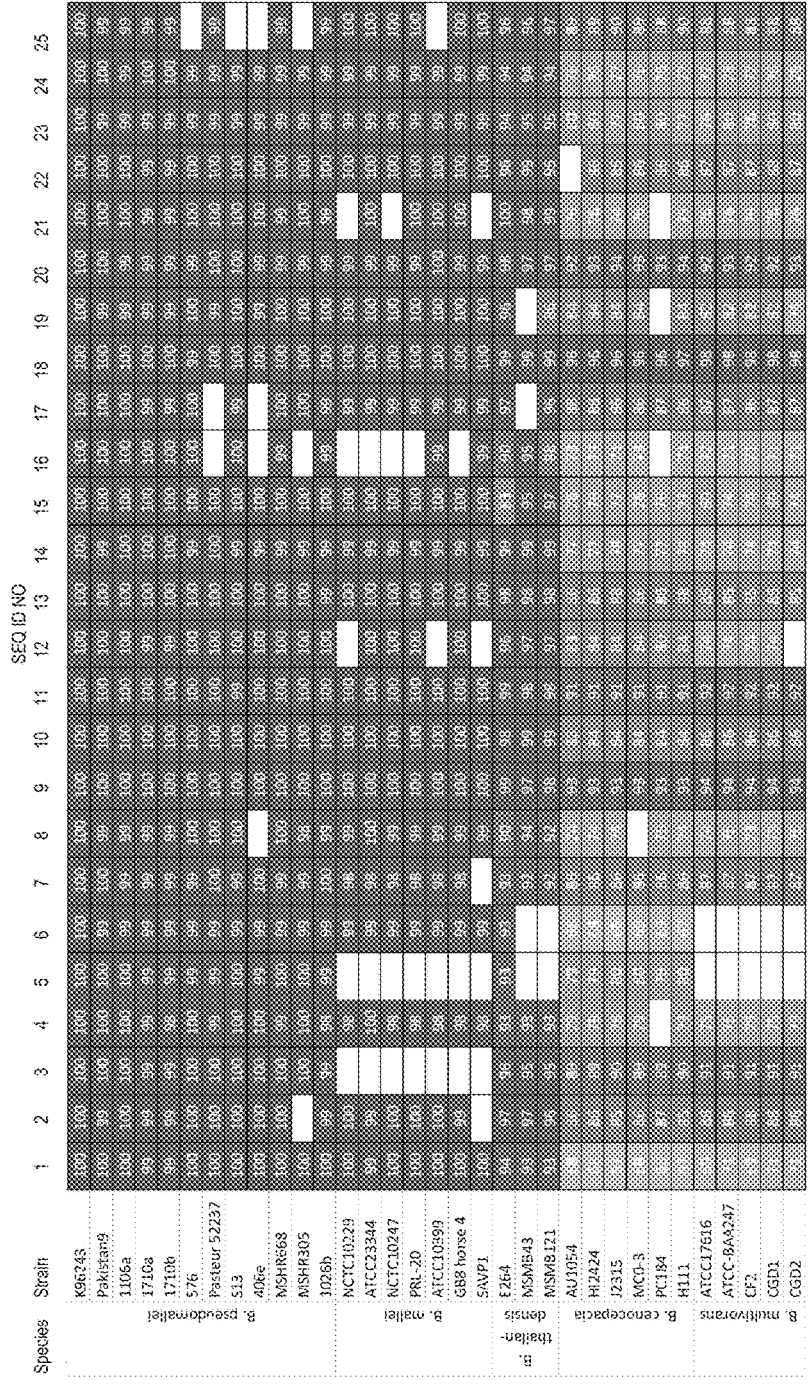

```
E264        ------------------mewatstrvraiaaaagvafcaaashaqaqavrpgadar-----
K96243      mmkvrpsrplcnleqrkmewatstrvraiaagva-fyaaaaghaqaqaaqpgadar-----
NCTC10229   -mkvrpsrplcnleqrkmewatstrvraiaagva-fyaaaaghaqaqaaqpgadar-----
AU1054      ----------mkkveqkkmewatgtrlraiaaaasvafgtaaaaghayaqtapavnagatas
ATCC17616   ---------------meqkkmdwatgtrlraiaaaasvafgaaaagqafaqttpaanaqasa-
                           *  *** ** *****           **        *    *

E264        ------qpgsqvngdtaaggtlpaisvsagaerdasvglvarrsttgtktdtpiveipqti
K96243      ------qpggeakadtaaggtlpaisvsgaaerdasvglvarrsmtgtktdtpiieipqti
NCTC10229   ------qpggeakadtaaggtlpaisvsgaaerdasvglvarrsmtgtktdtpiieipqti
AU1054      assaqtgatattstsaqngtlpaitvnaasagdgtvglvakrsttgtktdtplneipqti
ATCC17616   -------------pnaasagtlpaitvnaasegdgtvglvakrsrtgtktdtpieeipqti
                         *  ****** *         *   ***** ** ******** ******

E264        nivtaqqieatgatdinqafryipgfstygsdnrsdwyaalrgftptvfvdglqvpntin
K96243      nvvtaqqieatgatdinqafryipgfssygsdnrsdwyaalrgftptvfvdglqvpntin
NCTC10229   nvvtaqqieatgatdinqafryipgfssygsdnrsdwyaalrgftptvfvdglqvpntin
AU1054      nvvtaqqiemtgatdvnaalryvpgfssygsdnrsdwyaalrgftptayvnglqvpntin
ATCC17616   nvvtaqqiemtgatdvntalryvpgfssygsdnrsdwyaalrgftptayvnglqvpntln
            * *******  ****** *  * *** ****  ********************  * ******* *

E264        lsswrvdpymidsiavlrgptsvlygqgdpgaivdvqsklangerirevgvqvgnyarkq
K96243      lsswrvdpymidsiavlrgptsvlygqgdpgaivdvqsklangerirelgvqvgnyarkq
NCTC10229   lsswrvdpymidsiavlrgptsvlygqgdpgaivdvqsklangerirelgvqvgnyarkq
AU1054      laswrvdpymidsisvlrgptsvlygagdpgaiidvhtkladgervreagvqignyarkq
ATCC17616   lsswrvdpymidsitvlrgptsvlygagdpgaivdvktkladgervreagveignyarkq
            * *********** ************* ******  *** *** ** **  *******

E264        lmfdigdkidkdgtlsyrivgvgrdgnaqtgpladqrvsfapslkwqpnantsltlaaty
K96243      lmfdigdtigkdgtlsyrivgvgrdgnaqtgpladqrvsfapslkwqpnadtsltlaaty
NCTC10229   lmfdigdtigkdgtlsyrivgvgrdgnaqtgpladqrvsfapslkwqpnadtsltlaaty
AU1054      fmidvgdkldpdgkyayrfvgvardgnaltgpnndqrvalapsfrwrpdadtsitlsaty
ATCC17616   fmidvgdkldpdgkyayrfvgvardgnavtgpnndqrvalapsfrwrpnadtsitlsaty
            * * **   **    *** **** *** **** *** *   **  * *  * ***** ***

E264        lqdwgdtssnflpsrgtvlpnpngmisddlytadanfdhyrkkqwsigyqfehklnpvwt
K96243      lqdwgdtssnflpsrgtvlpnpngtisddlytadanfdhyrkkqwslgyqfehklnpvwt
NCTC10229   lqdwgdtssnflpsrgtvlpnpngtisddlytadanfdhyrkkqwslgyqfehklnpvwt
AU1054      lqdwgdissnflpaqgtvlpnpngqinkdiyegdgnfnyyrkkqwsvgyqfernltpawt
ATCC17616   lqdwgdissnflpaagtvlpnpngqitkdiyegdgnfnyyrkkqwsigyqfehnlnsmwt
            ****** ****** ***********  * *    *  *  ****** ****    *  **

E264        frqnvrwmhlaiddasvygggldgadptmatmtryaglfqfnysrfdvdnqaqakfttgp
K96243      lrqnvrwmhlsiddasvygggldgadptmatmtryaglfqfnysrfdvdnqaqakfttgp
NCTC10229   lrqnvrwmhlsiddasvygggldgadptmatmtryaglfqfnysrfdvdnqaqakfttgp
AU1054      frqntrlmhlsldngsvfgngfveg--sttdvsrwagvfqmnysrfdidnnlegrfatgp
ATCC17616   frqntrwmhlsvdngsvwgagfade--tlteinrwagvfqmnysrfdidnnlegrfatgp
            ***  * ***  *  *  *              *  *** ***** * **    * ***

E264        lshtllfgfdynrqtttdsewlakgpglnlyrpvytpipadifsgpnayprtdtkttlna
K96243      lshtllfgfdynrqtttdsewlakgpslnlyrpvytpipsdifsgpnayprtdtkttlna
NCTC10229   lshtllfgfdynrqtttdsewlakgpslnlyrpvytpipsdifsgpna-srtdtkttlna
AU1054      lqhtlllgfqynrqtatdsewlaaapplniynpvyqpvttavft-pdatirtntyttint
ATCC17616   lqhtlllgfqynrqtatdsewlaaaptlnlynpvytpvttavfsdpdttyrtntyttmnt
            * ****  ** ***** ** *******        ** * **      ** *  * **  * *
```

```
E264        fglyvqdqikwqrwvltlggrqdwtrtsqddiansasfkqndhafsgrvgltylgdygla
K96243      fglyvqdqikwrrwvltlggrqdwtrtsqddianaasfrqndhafsgrvgltylgdygla
NCTC10229   fglyvqdqikwrrwvltlggrqdwtrtsqddianaasfrqndhafsgrvgltylgdygla
AU1054      fglyaqdqikwnrwtltlggredwvnmrmddraagtstkadvtaftgrvgltyqgdygls
ATCC17616   fglyaqdqikwnrwtltlggredwvnmrmddraagtqskadvsaftgrvgltyqagygls
            ****  *******  **  ****** **       **  *          **  *******    ***

E264        pylsystsfnpqigvklaggglatptkgrqieaglrwqppgknlmlnaavyqinqtnvam
K96243      pylsystsfnpqigiklaggglatptkgrqieaglrwqppgknlmlnaavyqinqtnvam
NCTC10229   pylsystsfnpqigiklaggglatptkgrqieaglrwqppgknlmlnaavyqinqtnvam
AU1054      pyvsyatsfnpligvnlvggglpqptrgkqieaglrwqppgknlmlnaaiyqinqtnvlt
ATCC17616   pyisystsfnpligvslidggvpkptrgrqieaglrwqppgknlmlnaaiyqinqtngvt
            **  **  *****  **     *   **      **  * *********************  *******

E264        s--npndptsstfvqvgevrsrgvelsavgnlsrelsviaayvyqdvknvqandntlnkw
K96243      s--npndptsstfvqvgevrsrgvelsavgnlsrelsviaayvyqdvknvrandntlnkw
NCTC10229   s--npndptsstfvqvgevrsrgvelsavgnlsrelsviaayvyqdvknvrandntlnkw
AU1054      salpsqdptgtksvqtgevrsrgielsatgkvtrnlsviasyvyqdvknvqandvslnnw
ATCC17616   palptqdpggtksvqtgevrargielsatgkvtpnlsliasyayqdvkvvqandatlnnw
            *  *     **  ****  **  ****  *         **  **  * *****  *  ***    **  *

E264        pvdvprprqiaslwadwtwrngpltgfgvgagvrymsaaagaadnsltvpsytlfdaalh
K96243      pvdvprprqiaslwadwtwrtgpltgfgvgagvrymsaaagaadnsltvpsytlfdaalh
NCTC10229   pvdvprprqiaslwadwtwrtgpltgfgvgagvrymsaaagavdnsltvpsytlfdaalh
AU1054      pvdiprprqmaslwtdwtwytgplagfglgggiryqsasagaadnsltvssvtlfdaglh
ATCC17616   pvdiprprqmaslwadwtwhtgplagfglgggvryqsasagaadnsltvssytlidaavh
            ***  *****  ****  ****   ***  ***  *  **  **  ***  ******   *  **  **    *

E264        yelrnwrfalnatnlfnrryvagcqsdsvcmygnqrtviatakynw
K96243      yelrnwrfalnatnlfnrryvagcqsdavcmygnqrtviatakynw
NCTC10229   yelrnwrfalnatnlfnrryvagcqsdavcmygnqrtviatakynw
AU1054      ydvrnwrfavngtnlfnrhyisgcqsnnvcifgtdrtviatakynw
ATCC17616   ydvrnwrfavnatnlfnrhyisgcqstsvcmfgndrtviatakynw
            *  ******  *  ******  *   ****   **    *    ***********
```

```
AU1054      ---------mnnlhntnglmrfakvaaastllatillaacavgpdykrpdaaapaafkeaptla
ATCC17616   mlednkmdnmhntnglmriakvaaastllatillaacavgpdykrpdvttpaafkeaptla
E264        --------mnktnineriarvakiaaasgllvallaacavgpdyrrpdvatpaafkeapala
K96243      --------mnktnineriarvakiaaasgllvallaacavgpdyrrpdvatpaafkeapala
NCTC10229   --------mnktnineriarvakiaaasgllvallaacavgpdyrrpdvatpaafkeapala
                     *  ** ****  **  ***********  ***    ********* **

AU1054      ageqagtwktaepadgehrgewwkvfgdpvldsletqalaanqnlkaaaarveearaatr
ATCC17616   pgeqagtwkpaepadgahrgewwkvfgdpvldaleeqalaanqnlkaaaarveearaatr
E264        pgeqagtwktaepaddahrgewwrvfgdpaldaletqalaanqnlkaaaarveqaraatr
K96243      pgeqagtwkaaepadaahrgewwrvfgdpvldaletqalaanqnlkaaaarveqaraatr
NCTC10229   pgeqagtwkaaepadaahrgewwrvfgdpvldaletqalaanqnlkaaaarveqaraatr
             ********  ****  ***** ***** ** ** ******************  ******

AU1054      sarsqwfpqvgagfgptreglssasqfqpqgtgptnatlwraqgtvsyeadlfgrvgrnv
ATCC17616   tarsqwfpqvgvgfgptreglssasqfqpqgtgptnatlwraqgtvsyeadlfgrvsrnv
E264        aarsqwfpqvgvgfgptreglspasqfqpqgsgptnatlwraqgtvsyeadlfgrvgrnv
K96243      aarsqwfpqvgvgfgptreglssasqfqpqgsgptnatlwraqgtvsyeadlfgrvgrnv
NCTC10229   aarsqwfpqvgvgfgptreglssasqfqpqgsgptnatlwraqgtvsyeadlfgrvgrnv
             ********* ***********  ********* *****************************  ***

AU1054      easradqaqsealfrsvqlalqadvaqnyfelrqldsdqdlyrrtvelreqalklvqrrf
ATCC17616   easradqaqsealfrsvqlalqadvaqnyfelrqldsdqdlyrrtvelreealklvqrrf
E264        easradeaqsqalfrsvqlalqadvaqnyfelrrldsdqdlyrrtvelreealklvqrrf
K96243      easradeaqsqalfrsvqlalqadvaqnyfelrrldsdqdlyrrtvglreealklvqrrf
NCTC10229   easradeaqsqalfrsvqlalqadvaqnyfelrrldsdqdlyrrtvglreealklvqrrf
             ***** *** *********************** ************   ***  *********

AU1054      neqdiseldvsraknelasaqadavgvarrraasehalaillgkapadfafketpivpva
ATCC17616   neqdiseldvsraknelasaqadavgvarrraasehalaillgkapadfafketplvpva
E264        seqdiseldvsraknelataqadsvgvarrraasehalaillgkapadfsfketpivpva
K96243      aeqdiseldvsraknelataqadavgvarrraasehalailllgkapadfsfsetpiapvv
NCTC10229   aeqdiseldvsraknelataqadavgvarrraasehalailllgkapadfsfsetpiapva
              ****************  ****   *************** ********* *  ***    **

AU1054      vkippglpsallerrpdvsaaeramaaanariglaksayfpklditgsfgyeastlgnlf
ATCC17616   vkippglpsallerrpdvaaaeramaaanariglaksayfpklditgsfgyeastlgnlf
E264        vrvpaglpsallerrpdiaaaerammaanariglaksayfpklditgsfgyeaatlgnlf
K96243      vrvpaglpsallerrpdiaaaerammaanariglaksayfpklditgafgyeaatlgnlf
NCTC10229   vrvpaglpsallerrpdiaaaerammaanariglaksayfpklditgafgyeaatlgnlf
             *   * *********  ******  *  *********************** ***** ******

AU1054      lwssrtfllgpfagtaltlplfdggrraagvqqaraqydeqvanyrqqvlvafrevednl
ATCC17616   lwssrtfllgpfagtaltlplfdggrraagvqqaraqydeqvanyrqqvlvafrevednl
E264        lwssrtfllgpfagtaltlpifdggrrsagvaqarakydeevanyrqqvlvafrevednl
K96243      lwssrtfllgpfagtaltlpifdggrrsagvaqarakydeevanyrqqvlvafrevednl
NCTC10229   lwssrtfllgpfagtaltlpifdggrrsagvaqarakydeevanyrqqvlvafrevednl
             ******************* ******* *** ****** *** ********************

AU1054      adlrllddqiraqdaavnasrraatisrtqyqegevayldvidsersvlqsqlqanqltg
ATCC17616   adlrllddqiraqnaavnasrraatisrtqyqegevayldvidsersvlqsqlqanqltg
E264        adlrllddqiraqsdavnasrraaklsrtqyqegavsylevidsersvlesqlqsnqltg
K96243      adlrllddqiraqsdavnasrraaklsrtqyqegavsyldvidsersvlesqlqsnqltg
NCTC10229   adlrllddqiraqsdavnasrraaklsrtqyqegavsyldvidsersvlesqlqsnqltg
             *************   ********* ********* * **  ********* **** *****

AU1054      aqavstvnliralgggwgnapaptavgdaasqkadvaar
ATCC17616   aqavstvnliralgggwgeaptav--dgaaaakaeiagr
E264        tqavstvnliralgggwgndvav----gsrepnkqdvaar
K96243      tqavstvnliralgggwgsdaal----gsrepgkqdvatr
NCTC10229   tqavstvnliralgggwgsdaal----gsrepgkqdvaar
             ***************              *    *   *
```

```
E264         mktapapdagriealarlihdrrragrprrksssflflsshsreetkmntkiatrlsvfal
K96243       ------------------------------------------------mntkiatrlsvfal
NCTC10229    ------------------------------------------------mntkiatrlsvfal
AU1054       ------------------------------------------------mnmkiatrlsvfal
ATCC17616    ------------------------------------------------mnmkiatrlsvfal
                                                             ** **********

E264         agallagcatqqgtntavgtgtgaalgagigalagggkgaaigagvgalvggvtgynwqa
K96243       agallagcatqqgtntavgtgtgaalgagigalagggkgaaigagvgalvggvtgynwqa
NCTC10229    agallagcatqqgtntavgtgtgaalgagigalagggkgaaigagvgalvggvtgynwqa
AU1054       agallagcatqqgnntavgtgtgaalgagigalagggkgaaigagvgalvggvtgynwqa
ATCC17616    agallagcatqqgnntavgtgtgaalgagigalagggkgaaigagvgalvggvtgynwqa
             ************ ***********************************************

E264         iknklapsaqqtgtqvteqpdgslkinvpssvtfatdqyavtpaftplindiattlnqnp
K96243       iknklapsaqqtgtqvteqpdgslkinvpssvtfatdqyaitpaftplindiattlnqnp
NCTC10229    iknklapsaqqtgtqvteqpdgslkinvpssvtfatdqyaitpaftplindiattlnqnp
AU1054       iknklapsaaqtgtqvteqpdgslkinvpssvtfatnqyaitpaftplindiattlnqnp
ATCC17616    iknklapsaaqtgtqvteqpdgslkinvpssvtfatnqyaitpaftplindiattlnqnp
             ********* ************************** *** *******************

E264         qitasvvgytdstgsaahnqtlsqnraqsvvnalaqrgvaatrlsaqgmgasnpiadnat
K96243       qitasvvgytdstgsaahnqtlsqnraqsvvnalaqrgvaanrlsaqgmgasnpiadnat
NCTC10229    qitasvvgytdstgsaahnqtlsqnraqsvvnalaqrgvaanrlsaqgmgasnpiadnat
AU1054       qvtasivgytdstgsaqlnqtlsqnraqsvvnalvqrgvnggrlsaqgmgpsnpiadnat
ATCC17616    qvtasvigytdstgsaqlnqtlsqnraqsvvnalvqrgvagnrlsaqgmgpsnpvadnst
             * *** ********** **************** **** ******** *** *** *

E264         eagraqnrrveiylrapqaaq
K96243       eagraqnrrveiylrapqaaq
NCTC10229    eagraqnrrveiylrapqasq
AU1054       eagraqnrrveiylrapqqhq
ATCC17616    eagraqnrrveiylrapqhq-
             *****************
```

FIG. 7

POLYPEPTIDES AND IMMUNIZING COMPOSITIONS CONTAINING *BURKHOLDERIA* POLYPEPTIDES AND METHODS OF USE

CROSS-REFERENCE TO RELATED APPLICATION

This application claims priority to U.S. Provisional Patent Application Ser. No. 61/922,504, filed Dec. 31, 2013, which is incorporated herein by reference.

GOVERNMENT FUNDING

This invention was made with government support under HDTRA1-09-C-0019 awarded by the Defense Threat Reduction Agency. The government has certain rights in the invention.

SEQUENCE LISTING

This application contains a Sequence Listing electronically submitted via EFS-Web to the United States Patent and Trademark Office as an ASCII text file entitled "U.S. Ser. No. 14/586,157 SequenceListing_ST25.txt" having a size of 719 kilobytes and created on Feb. 10, 2015. The information contained in the Sequence Listing is incorporated by reference herein.

BACKGROUND

*Burkholderia* is a genus of proteobacteria known for its pathogenic members: *Burkholderia mallei*, responsible for glanders, a disease that occurs mostly in horses and related animals; *Burkholderia pseudomallei*, causative agent of melioidosis; and the *Burkholderia cepacia* complex, which includes pathogens that are involved in pulmonary infections of people with cystic fibrosis (CF). The *Burkholderia* genus name refers to a group of common gram-negative, motile, obligately aerobic rod-shaped bacteria including animal, human, and plant pathogens. Due to their antibiotic resistance and the high mortality rate from their associated diseases, *Burkholderia mallei* and *Burkholderia pseudomallei* are considered to be potential biological warfare agents, with livestock and humans as potential targets.

Humans and animals are believed to acquire *Burkholderia* infection by inhalation of contaminated dust or water droplets, ingestion of contaminated water, and contact with contaminated soil, especially through skin abrasions.

Many non-human animal species can be susceptible to melioidosis caused by *Burkholderia pseudomallei*, including many livestock and/or companion animal species such as, for example, sheep, goats, horses, swine, cattle, dogs, and cats.

In the absence of treatment with appropriate antibiotics, the septicemic form of melioidosis has a mortality rate that exceeds 90%. With appropriate antibiotic treatment, the mortality rate is about 10% for uncomplicated cases but up to 80% for cases with bacteremia or severe sepsis. Because of its severe course of infection, aerosol infectivity, and worldwide availability, *B. pseudomallei* is identified as a potential agent of biological warfare or bioterrorism and is listed on the Centers for Disease Control list as a Category B bioterrorism agent. There is currently no vaccine and the organism is often refractory to antibiotic therapy, especially after it is established in a host.

BRIEF DESCRIPTION OF THE FIGURES

FIG. 6A-C. Multiple cross-species sequence alignment for the *Burkholderia* spp. polypeptides across five *Burkholderia* species: *B. thailandensis* E264, *B. pseudomallei* K96243, *B. mallei* NCTC10229, *B. cenocepacia* AU1054, and *B. multivorans* ATCC17616. (A) SEQ ID NO:1, (B) SEQ ID NO:2, and (C) SEQ ID NO:9. (* indicates identity).

FIG. 7. Antibody titers to individual recombinant *Burkholderia* iron-regulated polypeptides in vaccinated mice.

DETAILED DESCRIPTION OF EXEMPLARY EMBODIMENTS

Figure 1:
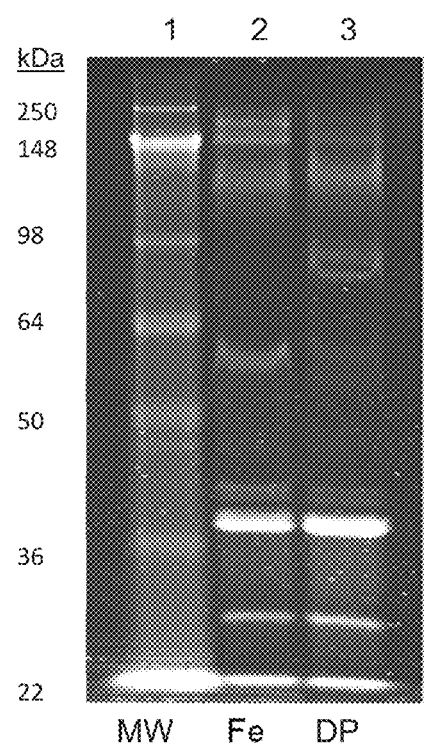
FIG. 1. SDS-PAGE (10%) analysis of polypeptides isolated from *B. thailandensis* grown in either iron-rich (Fe, Lane 2) or iron-restricted (DP, Lane 3) medium. Lane 1: molecular weight standard.

In one aspect, this disclosure provides polypeptides and compositions including polypeptides. As used herein, "polypeptide" refers to a polymer of amino acids linked by peptide bonds. Thus, for example, the terms peptide, oligopeptide, protein, and enzyme are included within the definition of polypeptide. This term also includes polypeptides that may include one or more post-expression modifications of the polypeptide such as, for example, a glycosylation, an acetylation, a phosphorylation, and the like. The term polypeptide does not connote a specific length of a polymer of amino acids. A polypeptide may be isolatable directly from a natural source or can be prepared with the aid of recombinant, enzymatic, or chemical techniques. In the case of a polypeptide that is naturally occurring, such a polypeptide is typically isolated.

An "isolated" polypeptide is one that has been removed from its natural environment. For instance, an isolated polypeptide is a polypeptide that has been removed from the cytoplasm or from the membrane of a cell, and many of the polypeptides, nucleic acids, and other cellular material of its natural environment are no longer present.

A polypeptide characterized as "isolatable" from a particular source is a polypeptide that, under appropriate conditions, is produced by the identified source, although the polypeptide may be obtained from alternate sources using, for example, conventional recombinant, chemical, or enzymatic techniques. Thus, characterizing a polypeptide as "isolatable" from a particular source does not imply any specific source from which the polypeptide must be obtained or any particular conditions or processes under which the polypeptide must be obtained.

A "purified" polypeptide is one that is at least 60% free, preferably at least 75% free, and most preferably at least 90% free from other components with which they are naturally associated. Polypeptides that are produced outside the organism in which they naturally occur, e.g., through chemical or recombinant means, are considered to be isolated and purified by definition, since they were never present in a natural environment.

As used herein, a "polypeptide fragment" refers to a portion of a polypeptide that results from digestion of a polypeptide with a protease.

Unless otherwise specified, "a," "an," "the," and "at least one" are used interchangeably and mean one or more than one. The terms "comprises" and variations thereof do not have a limiting meaning where these terms appear in the description and claims. Also, the term "and/or" means one or all of the listed elements or a combination of any two or more of the listed elements.

Generally, a polypeptide may be characterized by molecular weight, mass fingerprint, amino acid sequence, nucleic acid that encodes the polypeptide, immunological activity, or any combination of two or more such characteristics. The molecular weight of a polypeptide, typically expressed in kilodaltons (kDa), can be determined using routine methods including, for instance, gel filtration, gel electrophoresis including sodium dodecyl sulfate (SDS) polyacrylamide gel electrophoresis (PAGE), capillary electrophoresis, mass spectrometry, liquid chromatography (including HPLC), and calculating the molecular weight from an observed or predicted amino acid sequence. Unless indicated otherwise, molecular weight refers to molecular weight as determined by resolving a polypeptide using an SDS polyacrylamide gel having a stacking gel of about 4% and a resolving gel of about 10% under reducing and denaturing conditions.

As used herein, a "mass fingerprint" refers to a population of polypeptide fragments obtained from a polypeptide after digestion with a protease. Often, a mass fingerprint can be generated by digesting a polypeptide with trypsin. In principle, however, a mass fingerprint may be generated by digesting the polypeptide with any suitable protease. Typically, the polypeptide fragments resulting from a digestion are analyzed using a mass spectrometric method. Each polypeptide fragment is characterized by a mass, or by a mass (m) to charge (z) ratio, which is referred to as an "m/z ratio" or an "m/z value." Methods for generating a mass fingerprint of a polypeptide are routine. An example of such a method is disclosed in Example 3.

The polypeptides described herein may be metal-regulated. As used herein, a "metal-regulated polypeptide" is a polypeptide that is expressed by a microbe at a greater level when the microbe is grown in low metal conditions compared to when the same microbe is grown in high metal conditions. Low metal and high metal conditions are described herein. For instance, certain metal-regulated polypeptides produced by Burkholderia spp. are not expressed at detectable levels during growth of the microbe in high metal conditions but are expressed at detectable levels during growth in low metal conditions.

Examples of metal-regulated polypeptides isolatable from B. thailandensis after growth in low iron conditions include metal-regulated polypeptides having molecular weights of 88 kDa, 84 kDa, 83 kDa, 81 kDa, 58 kDa, 56 kDa, 55 kDa, 44 kDa, 43 kDa, 42 kDa, 27 kDa, 24 kDa, or 19 kDa.

Additional examples of metal-regulated polypeptides include recombinantly-produced versions of polypeptides described herein. A recombinantly-produced polypeptide may include the entire amino acid sequence translatable from an mRNA transcript. Alternatively, a recombinantly-produced metal-regulated polypeptide can include a fragment or portion of the entire translatable amino acid sequence. For example, a recombinantly-produced metal-regulated polypeptide may lack a cleavable sequence at either terminal of the polypeptide—e.g., a cleavable signal sequence at the amino terminal of the polypeptide.

Thus, a metal-regulated polypeptide can be a polypeptide that includes the amino acid sequence depicted in, for example, SEQ ID NO:6, SEQ ID NO:3, SEQ ID NO:4, SEQ ID NO:1, SEQ ID NO:7, SEQ ID NO:16, SEQ ID NO:22, SEQ ID NO:2, SEQ ID NO:13, SEQ ID NO:25, SEQ ID NO:21, SEQ ID NO:9, SEQ ID NO:11, or SEQ ID NO:10.

This disclosure also describes certain polypeptides that are not metal-regulated. Such polypeptides are expressed in the presence of a metal ion such as, for example, in the presence of ferric chloride, and also expressed when grown in low iron conditions. Examples of such polypeptides isolatable from *B. thailandensis* have molecular weights of 55 kDa, 40 kDa, 39 kDa, or 19 kDa.

Additional examples of polypeptides that are not metal-regulated include recombinantly-produced versions of polypeptides described herein. A recombinantly-produced polypeptide may include the entire amino acid sequence translatable from an mRNA transcript. Alternatively, a recombinantly-produced non-metal-regulated polypeptide can include a fragment or portion of the entire translatable amino acid sequence. For example, a recombinantly-produced non-metal-regulated polypeptide may lack a cleavable sequence at either terminal of the polypeptide—e.g., a cleavable signal sequence at the amino terminal of the polypeptide.

Thus, a polypeptide that is not metal-regulated can be a polypeptide that includes the amino acid sequence depicted in, for example, SEQ ID NO:15, SEQ ID NO:12, SEQ ID NO:14, and SEQ ID NO:18.

This disclosure also describes certain polypeptides whose metal-regulation has not been established with certainty. Such polypeptides may have been detected in the extract when grown in low iron or in the presence of iron. Alternatively, they may have been identified through bioinformatics analysis using structural similarity to known iron receptor proteins or functional roles in iron acquisition or storage. Examples of such polypeptides isolatable from *B. thailandensis* have molecular weights of 85 kDa, 81 kDa, 78 kDa, 55 kDa, 36 kDa, or 8.5 kDa.

Additional examples of polypeptides whose metal regulation is uncertain include recombinantly-produced versions of polypeptides described herein. A recombinantly-produced polypeptide may include the entire amino acid sequence translatable from an mRNA transcript. Alternatively, a recombinantly-produced polypeptide whose metal regulation is uncertain can include a fragment or portion of the entire translatable amino acid sequence. For example, a recombinantly-produced polypeptide whose metal regulation is uncertain may lack a cleavable sequence at either terminal of the polypeptide—e.g., a cleavable signal sequence at the amino terminal of the polypeptide.

Thus, a polypeptide whose metal regulation is uncertain can be a polypeptide that includes the amino acid sequence depicted in, for example, SEQ ID NO:23, SEQ ID NO:5, SEQ ID NO:8, SEQ ID NO:24, SEQ ID NO:17, SEQ ID NO:20, and SEQ ID NO:19.

Whether a polypeptide is a metal-regulated polypeptide or a non-metal-regulated polypeptide can be determined by methods useful for comparing the presence of polypeptides, including, for example, gel filtration, gel electrophoresis including sodium dodecyl sulfate-polyacrylamide gel electrophoresis (SDS-PAGE), capillary electrophoresis, mass spectrometry, isobaric tags for relative and absolute quantification (iTRAQ), and liquid chromatography including HPLC. Separate cultures of a microbe can be grown under high metal conditions and under low metal conditions, polypeptides may be isolated as described herein, and the polypeptides present in each culture can be resolved and compared. Typically, an equal amount of polypeptides from each culture is used. Preferably, the polypeptides can be resolved using an SDS polyacrylamide gel having a stacking gel of about 4% and a resolving gel of about 10% under reducing and denaturing conditions. For instance, 30 micrograms (µg) of total polypeptide from each culture may be used and loaded into wells of a gel. After running the gel and staining the polypeptides with Coomassie Brilliant Blue, the two lanes can be compared. When determining whether a polypeptide is or is not expressed at a detectable level, 30 µg of total polypeptide from a culture is resolved on an SDS-PAGE gel and stained with Coomassie Brilliant Blue using methods known in the art. A polypeptide that can be visualized by eye is considered to be expressed at a detectable level, while a polypeptide that cannot be visualized by eye is considered to not be expressed at a detectable level.

Alternatively, whether a polypeptide is a metal-regulated polypeptide or a non-metal-regulated polypeptide can be determined using microarray-based gene expression analysis. Separate cultures of a microbe can be grown under high metal conditions and under low metal conditions, RNA can be extracted from cells of each culture, and differences in RNA expression in cells grown in high metal conditions versus RNA expression in cells grown in low metal conditions can be detected and compared. For example, labeled cDNA can be prepared from 8-10 µg of bacterial RNA using established protocols. The labeled cDNA can be applied to a microarray of the Burkholderia spp. genome. Such microarrays are commercially available and gene expression using such arrays is routine.

The polypeptides described herein may have immunological activity. "Immunological activity" refers to the ability of a polypeptide to elicit an immunological response in an animal. An immunological response to a polypeptide is the development in an animal of a cellular and/or antibody-mediated immune response to the polypeptide. Usually, an immunological response includes but is not limited to one or more of the following effects: the production of antibodies, B cells, helper T cells, suppressor T cells, and/or cytotoxic T cells, directed to an epitope or epitopes of the polypeptide. "Epitope" refers to the site on an antigen to which specific B cells and/or T cells respond so that antibody is produced. The immunological activity may be protective. "Protective immunological activity" refers to the ability of a polypeptide to elicit an immunological response in an animal that inhibits or limits infection by Burkholderia spp. such as, for example, B. thailandensis, B. mallei, B. pseudomallei, B. cenocepacia, or B. multivorans. Whether a polypeptide has protective immunological activity can be determined by methods known in the art such as, for example, methods described in Example 6. For example, a polypeptide, or combination of polypeptides, can protect a rodent such as a mouse against challenge with a Burkholderia spp. A polypeptide may have seroactive activity. As used herein, "seroactive activity" refers to the ability of a candidate polypeptide to react with antibody present in convalescent serum from an animal infected with a Burkholderia spp. such as, for example, B. thailandensis, B. mallei, B. pseudomallei, B. cenocepacia, or B. multivorans. In some aspects, the convalescent serum may be from an animal infected with B. thailandensis E264, B. pseudomallei K96243, B. mallei NCTC10229, B. cenocepacia AU1054, or B. multivorans ATCC17616.

A polypeptide may have immunoregulatory activity. As used herein, "immunoregulatory activity" refers to the ability of a polypeptide to act in a nonspecific manner to enhance an immune response to a particular antigen. Methods for determining whether a polypeptide has immunoregulatory activity are known in the art.

Figure 5:
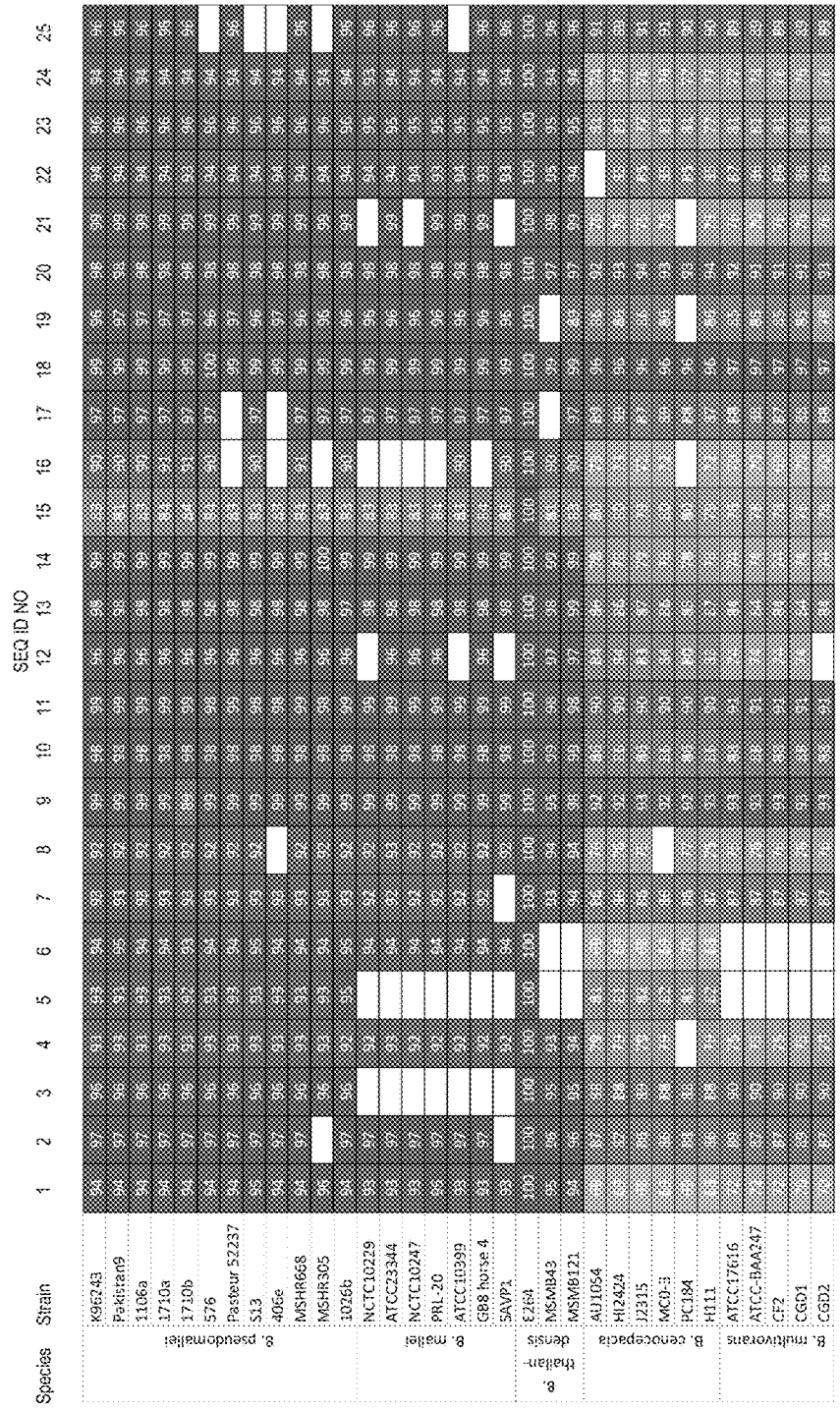
FIGS. 5A-B. Protein conservation across *Burkholderia* strains and species. (A) Heat map showing the percent amino acid identity for 25 receptor proteins was determined in 12 strains of *B. pseudomallei*, seven strains of *B. mallei*, three strains of *B. thailandensis*, six strains of *B. cenocepacia*, and five strains of *B. multivorans* using *B. pseudomallei* K96243 as the query. (B) Heat map showing the percent amino acid identity for 25 receptor proteins was determined in 12 strains of *B. pseudomallei*, seven strains of *B. mallei*, three strains of *B. thailandensis*, six strains of *B. cenocepacia*, and five strains of *B. multivorans* using *B. thailandensis* E264 as the query.

A polypeptide as described herein may have the characteristics of a polypeptide expressed by a reference microbe—i.e., a reference polypeptide. The characteristics can include, for example, molecular weight, mass fingerprint, amino acid sequence, or any combination thereof. The reference microbe can be a gram negative, preferably a member of the family Burkholderiaceae, preferably, Burkholderia spp. such as, for example, B. thailandensis, B. mallei, B. pseudomallei, B. cenocepacia, or B. multivorans. Exemplary strains of Burkholderia spp. and representative strains are listed in FIG. 5.

When the reference microbe is B. thailandensis E264, a candidate polypeptide can be considered to be a polypeptide as described herein if it has a molecular weight of 88 kDa, 84 kDa, 83 kDa, 81 kDa, 58 kDa, 56 kDa, 55 kDa, 44 kDa, 43 kDa, 42 kDa, 27 kDa, 24 kDa, or 19 kDa and has a mass fingerprint that is similar to the mass fingerprint of a metal-regulated polypeptide expressed by a reference microbe and having a molecular weight of—88 kDa, 84 kDa, 83 kDa, 81 kDa, 58 kDa, 56 kDa, 55 kDa, 44 kDa, 43 kDa, 42 kDa, 27 kDa, 24 kDa, or 19 kDa, respectively. Preferably, such polypeptides are metal-regulated. For instance, a candidate polypeptide can be a polypeptide as described herein if it has a molecular weight of 88 kDa and has a mass fingerprint similar to the mass fingerprint of an 88 kDa metal-regulated polypeptide produced by the reference strain B. thailandensis E264.

Alternatively, when the reference microbe is B. thailandensis E264, a candidate polypeptide can be considered to be a polypeptide as described herein if it has an amino acid sequence that is structurally similar, as described in detail below, to the amino acid sequence of SEQ ID NO:6, SEQ ID NO:3, SEQ ID NO:4, SEQ ID NO:1, SEQ ID NO:7, SEQ ID NO:16, SEQ ID NO:22, SEQ ID NO:2, SEQ ID NO:13, SEQ ID NO:25, SEQ ID NO:21, SEQ ID NO:9, SEQ ID NO:11, or SEQ ID NO:10.

When the reference microbe is B. thailandensis E264, a candidate polypeptide can be considered to be a polypeptide as described herein if it has a molecular weight of 55 kDa, 40 kDa, 39 kDa, or 19 kDa and has a mass fingerprint that is similar to the mass fingerprint of a non-metal-regulated polypeptide expressed by a reference microbe and having a molecular weight of 55 kDa, 40 kDa, 39 kDa, or 19 kDa, respectively. Preferably, such polypeptides are non-metal-regulated. For instance, a candidate polypeptide can be a polypeptide as described herein if it has a molecular weight of 55 kDa and has a mass fingerprint similar to the mass fingerprint of a 55 kDa non-metal-regulated polypeptide produced by the reference strain B. thailandensis E264.

Alternatively, when the reference microbe is *B. thailandensis* E264, a candidate polypeptide can be considered to be a polypeptide as described herein if it has an amino acid sequence that is structurally similar, as described in detail below, to the amino acid sequence of SEQ ID NO:15, SEQ ID NO:12, SEQ ID NO:14, or SEQ ID NO:18.

When the reference microbe is *B. thailandensis* E264, a candidate polypeptide can be considered to be a polypeptide as described herein if it has a molecular weight of 85 kDa, 81 kDa, 78 kDa, 55 kDa, 36 kDa, or 8.5 kDa, respectively. Preferably, such polypeptides may or may not be metal-regulated. For instance, a candidate polypeptide can be a polypeptide as described herein if it has a molecular weight of 85 kDa and has a mass fingerprint similar to the mass fingerprint of an 85 kDa polypeptide produced by the reference strain *B. thailandensis* E264.

Alternatively, when the reference microbe is *B. thailandensis* E264, a candidate polypeptide can be considered to be a polypeptide as described herein if it has an amino acid sequence that is structurally similar, as described in detail below, to the amino acid sequence of SEQ ID NO:23, SEQ ID NO:5, SEQ ID NO:8, SEQ ID NO:24, SEQ ID NO:17, SEQ ID NO:20, or SEQ ID NO:19.

As used herein, a polypeptide may be "structurally similar" to a reference polypeptide if the amino acid sequence of the polypeptide possesses a specified amount of sequence similarity and/or sequence identity compared to the reference polypeptide. A polypeptide also may be "structurally similar" to a reference polypeptide if the polypeptide exhibits a mass fingerprint possessing a specified amount of identity compared to a comparable mass fingerprint of the reference polypeptide. Thus, a polypeptide may be "structurally similar" to a reference polypeptide if, compared to the reference polypeptide, it possesses a sufficient level of amino acid sequence identity, amino acid sequence similarity, mass fingerprint similarity, or any combination thereof.

Polypeptide Sequence Similarity and Polypeptide Sequence Identity

Structural similarity of two polypeptides can be determined by aligning the residues of the two polypeptides (for example, a candidate polypeptide and any appropriate reference polypeptide described herein) to optimize the number of identical amino acids along the lengths of their sequences; gaps in either or both sequences are permitted in making the alignment in order to optimize the number of identical amino acids, although the amino acids in each sequence must nonetheless remain in their proper order. A reference polypeptide may be a polypeptide described herein or any known metal-regulated polypeptide, as appropriate. A candidate polypeptide is the polypeptide being compared to the reference polypeptide. A candidate polypeptide can be isolated, for example, from a microbe, or can be produced using recombinant techniques, or chemically or enzymatically synthesized.

Unless modified as otherwise described herein, a pairwise comparison analysis of amino acid sequences can be carried out using the BESTFIT algorithm in the GCG package (version 10.2, Madison Wis.). Alternatively, polypeptides may be compared using the Blastp program of the BLAST 2 search algorithm, as described by Tatiana et al. (*FEMS Microbiol Lett,* 174:247-250 (1999)), and available on the National Center for Biotechnology Information (NCBI) website. The default values for all BLAST 2 search parameters may be used, including matrix=BLOSUM62; open gap penalty=11, extension gap penalty=1, gap x_dropoff=50, expect=10, wordsize=3, and filter on.

In the comparison of two amino acid sequences, structural similarity may be referred to by percent "identity" or may be referred to by percent "similarity." "Identity" refers to the presence of identical amino acids. "Similarity" refers to the presence of not only identical amino acids but also the presence of conservative substitutions. A conservative substitution for an amino acid in a polypeptide may be selected from other members of the class to which the amino acid belongs. For example, it is well-known in the art of protein biochemistry that an amino acid belonging to a grouping of amino acids having a particular size or characteristic (such as charge, hydrophobicity, or hydrophilicity) can be substituted for another amino acid without altering the activity of a protein, particularly in regions of the protein that are not directly associated with biological activity. For example, nonpolar (hydrophobic) amino acids include alanine, leucine, isoleucine, valine, proline, phenylalanine, tryptophan, and tyrosine. Polar neutral amino acids include glycine, serine, threonine, cysteine, tyrosine, asparagine and glutamine. The positively charged (basic) amino acids include arginine, lysine and histidine. The negatively charged (acidic) amino acids include aspartic acid and glutamic acid. Conservative substitutions include, for example, Lys for Arg and vice versa to maintain a positive charge; Glu for Asp and vice versa to maintain a negative charge; Ser for Thr so that a free —OH is maintained; and Gln for Asn to maintain a free —NH2. Likewise, biologically active analogs of a polypeptide containing deletions or additions of one or more contiguous or noncontiguous amino acids that do not eliminate a functional activity—such as, for example, immunological activity—of the polypeptide are also contemplated.

Thus, as used herein, reference to a polypeptide as described herein and/or reference to the amino acid sequence of one or more SEQ ID NOs can include a polypeptide with at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence similarity to the reference amino acid sequence.

Alternatively, as used herein, reference to a polypeptide as described herein and/or reference to the amino acid sequence of one or more SEQ ID NOs can include a polypeptide with at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to the reference amino acid sequence.

FIG. 6 shows cross-species sequence alignment for polypeptides having the amino acid sequences shown in SEQ ID NO:1, SEQ ID NO:2, and SEQ ID NO:9. The alignment indicates amino acids that are conserved in the variants of each polypeptide across five *Burkholderia* species. The alignment also shows regions of variability in the variants of each polypeptide across five *Burkholderia* species. A person of ordinary skill in the art can deduce from such data regions of the polypeptide in which substitutions, particularly conservative substitutions, may be permitted without unduly affecting biological activity of the modified polypeptide.

Consequently, a polypeptide as described herein can include certain variants including, for example, homologous polypeptides that originate-biologically and/or recombinantly—from microbial species or strains other than the microbial species or strain from which the polypeptide was originally isolated and/or identified.

For example, a polypeptide as described herein can include a polypeptide commonly known as a TonB-dependent siderophore receptor. One embodiment of this polypeptide is reflected in the amino acid sequence of SEQ ID NO:1. Variant embodiments are reflected in the amino acid sequences of SEQ ID NO:51, SEQ ID NO:101, SEQ ID NO:141, and SEQ ID NO:189.

For example, a polypeptide as described herein can include a polypeptide commonly known as resistance-nodulation-cell division (RND) superfamily efflux system outer membrane lipoprotein. One embodiment of this polypeptide is reflected in the amino acid sequence of SEQ ID NO:2. Variant embodiments are reflected in the amino acid sequences of SEQ ID NO:52, SEQ ID NO:102, SEQ ID NO:142, and SEQ ID NO:190.

For example, a polypeptide as described herein can include a polypeptide commonly known as outer membrane ferric siderophore receptor. One embodiment of this polypeptide is reflected in the amino acid sequence of SEQ ID NO:3. Variant embodiments are reflected in the amino acid sequences of SEQ ID NO:53, SEQ ID NO:143, and SEQ ID NO:191.

For example, a polypeptide as described herein can include a polypeptide commonly known as TonB-dependent heme/hemoglobin receptor family protein. One embodiment of this polypeptide is reflected in the amino acid sequence of SEQ ID NO:4. Variant embodiments are reflected in the amino acid sequences of SEQ ID NO:54, SEQ ID NO:103, SEQ ID NO:144, and SEQ ID NO:192.

For example, a polypeptide as described herein can include a polypeptide commonly known as Fe(III) pyochelin receptor. One embodiment of this polypeptide is reflected in the amino acid sequence of SEQ ID NO:5. Variant embodiments are reflected in the amino acid sequences of SEQ ID NO:55 and SEQ ID NO:145.

For example, a polypeptide as described herein can include a polypeptide commonly known as TonB-dependent siderophore receptor family protein. One embodiment of this polypeptide is reflected in the amino acid sequence of SEQ ID NO:6. Variant embodiments are reflected in the amino acid sequences of SEQ ID NO:56, SEQ ID NO:104, and SEQ ID NO:146.

For example, a polypeptide as described herein can include a polypeptide commonly known as TonB-dependent copper receptor. One embodiment of this polypeptide is reflected in the amino acid sequence of SEQ ID NO:7. Variant embodiments are reflected in the amino acid sequences of SEQ ID NO:57, SEQ ID NO:105, SEQ ID NO:147, and SEQ ID NO:193.

For example, a polypeptide as described herein can include a polypeptide commonly known as a TonB-dependent siderophore receptor. One embodiment of this polypeptide is reflected in the amino acid sequence of SEQ ID NO:8. Variant embodiments are reflected in the amino acid sequences of SEQ ID NO:58, SEQ ID NO:106, SEQ ID NO:148, and SEQ ID NO:194.

For example, a polypeptide as described herein can include a polypeptide commonly known as an OmpA family protein. One embodiment of this polypeptide is reflected in the amino acid sequence of SEQ ID NO:9. Variant embodiments are reflected in the amino acid sequences of SEQ ID NO:59, SEQ ID NO:107, SEQ ID NO:149, and SEQ ID NO:195.

For example, a polypeptide as described herein can include a polypeptide commonly known as OmpA family outer membrane protein. One embodiment of this polypeptide is reflected in the amino acid sequence of SEQ ID NO:10. Variant embodiments are reflected in the amino acid sequences of SEQ ID NO:60, SEQ ID NO:108, SEQ ID NO:150, and SEQ ID NO:196.

For example, a polypeptide as described herein can include a polypeptide commonly known as OmpA family protein that differs from the OmpA family protein described above. One embodiment of this polypeptide is reflected in the amino acid sequence of SEQ ID NO:11. Variant embodiments are reflected in the amino acid sequences of SEQ ID NO:61, SEQ ID NO:109, SEQ ID NO:151, and SEQ ID NO:197.

For example, a polypeptide as described herein can include a polypeptide commonly known as an outer membrane porin. One embodiment of this polypeptide is reflected in the amino acid sequence of SEQ ID NO:12. Variant embodiments are reflected in the amino acid sequences of SEQ ID NO:62, SEQ ID NO:152, and SEQ ID NO:198.

For example, a polypeptide as described herein can include a polypeptide commonly known as an outer membrane porin that differs from the outer membrane porin described above. One embodiment of this polypeptide is reflected in the amino acid sequence of SEQ ID NO:13. Variant embodiments are reflected in the amino acid sequences of SEQ ID NO:63, SEQ ID NO:110, SEQ ID NO:153, and SEQ ID NO:199.

For example, a polypeptide as described herein can include a polypeptide commonly known as an outer membrane porin that differs from the outer membrane porins described above. One embodiment of this polypeptide is reflected in the amino acid sequence of SEQ ID NO:14. Variant embodiments are reflected in the amino acid sequences of SEQ ID NO:64, SEQ ID NO:111, SEQ ID NO:154, and SEQ ID NO:200.

For example, a polypeptide as described herein can include a polypeptide commonly known as an outer membrane porin that differs from the outer membrane porins described above. One embodiment of this polypeptide is reflected in the amino acid sequence of SEQ ID NO:15. Variant embodiments are reflected in the amino acid sequences of SEQ ID NO:65, SEQ ID NO:112, SEQ ID NO:155, and SEQ ID NO:201.

For example, a polypeptide as described herein can include a polypeptide commonly known as a resistance-nodulation-cell division (RND) superfamily efflux system outer membrane lipoprotein. One embodiment of this polypeptide is reflected in the amino acid sequence of SEQ ID NO:16. Variant embodiments are reflected in the amino acid sequences of SEQ ID NO:66, SEQ ID NO:156, and SEQ ID NO:202.

For example, a polypeptide as described herein can include a polypeptide commonly known as a resistance-nodulation-cell division (RND) superfamily efflux system outer membrane lipoprotein. One embodiment of this polypeptide is reflected in the amino acid sequence of SEQ ID NO:17. Variant embodiments are reflected in the amino acid sequences of SEQ ID NO:67, SEQ ID NO:113, SEQ ID NO:157, and SEQ ID NO:203.

For example, a polypeptide as described herein can include a polypeptide commonly known as bacterioferritin (Bfr). One embodiment of this polypeptide is reflected in the amino acid sequence of SEQ ID NO:18. Variant embodiments are reflected in the amino acid sequences of SEQ ID NO:68, SEQ ID NO:114, SEQ ID NO:158, and SEQ ID NO:204.

For example, a polypeptide as described herein can include a polypeptide commonly known as bacterioferritin-associated ferredoxin (Bfd). One embodiment of this polypeptide is reflected in the amino acid sequence of SEQ ID NO:19. Variant embodiments are reflected in the amino acid sequences of SEQ ID NO:69, SEQ ID NO:115, SEQ ID NO:159, and SEQ ID NO:205.

For example, a polypeptide as described herein can include a polypeptide commonly known as dipeptide ABC transporter permease. One embodiment of this polypeptide is reflected in the amino acid sequence of SEQ ID NO:20. Variant embodiments are reflected in the amino acid sequences of SEQ ID NO:70, SEQ ID NO:116, SEQ ID NO:160, and SEQ ID NO:206.

For example, a polypeptide as described herein can include a polypeptide commonly known as an outer membrane porin that differs from the outer membrane porins described above. One embodiment of this polypeptide is reflected in the amino acid sequence of SEQ ID NO:21. Variant embodiments are reflected in the amino acid sequences of SEQ ID NO:71, SEQ ID NO:161, and SEQ ID NO:207.

For example, a polypeptide as described herein can include a polypeptide commonly known as a resistance-nodulation-cell division (RND) superfamily efflux system outer membrane lipoprotein. One embodiment of this polypeptide is reflected in the amino acid sequence of SEQ ID NO:22. Variant embodiments are reflected in the amino acid sequences of SEQ ID NO:72, SEQ ID NO:117, and SEQ ID NO:208.

For example, a polypeptide as described herein can include a polypeptide commonly known as a TonB-dependent receptor. One embodiment of this polypeptide is reflected in the amino acid sequence of SEQ ID NO:23. Variant embodiments are reflected in the amino acid sequences of SEQ ID NO:73, SEQ ID NO:118, SEQ ID NO:162, and SEQ ID NO:209.

For example, a polypeptide as described herein can include a polypeptide commonly known as a TonB-dependent receptor. One embodiment of this polypeptide is reflected in the amino acid sequence of SEQ ID NO:24. Variant embodiments are reflected in the amino acid sequences of SEQ ID NO:74, SEQ ID NO:119, SEQ ID NO:163, and SEQ ID NO:210.

For example, a polypeptide as described herein can include a polypeptide commonly known as resistance-nodulation-cell division (RND) superfamily efflux transporter MFP subunit. One embodiment of this polypeptide is reflected in the amino acid sequence of SEQ ID NO:25. Variant embodiments are reflected in the amino acid sequences of SEQ ID NO:75, SEQ ID NO:120, SEQ ID NO:164, and SEQ ID NO:211.

Table 1 summarizes identifying characteristics of reference polypeptides natively expressed by reference microbe *B. thailandensis* E264.

TABLE 1

| SEQ ID NO: | GI Number | Molecular Weight (kDa)[b] | Present by 2D gel/MS[c] | Present by iTRAQ | Iron-regulation[d] | Immuno-genicity[e] | Animal protection[f] |
|---|---|---|---|---|---|---|---|
| 1 | 83718630 | 81 | + | + | IR | + | + |
| 2 | 83717404 | 55 | + | + | IR | + | + |
| 3 | 83716122 | 84 | + | + | IR | + | + |
| 4 | 83717803 | 83 | ND | + | IR | + | + |
| 5 | 83716062 | 81 | ND | + | U | + | + |
| 6 | 83720594 | 88 | ND | + | IR | + | + |
| 7 | 83717103 | 81 | + | + | IR | + | + |
| 8 | 83717123 | 81 | ND | ND | U | + | ND |
| 9 | 83720098 | 27 | + | + | IR | NT | + |
| 10 | 83719210 | 19 | ND | + | IR | NT | + |
| 11 | 83720431 | 24 | + | + | IR | NT | + |
| 12 | 83719322 | 40 | + | + | NIR | NT | + |
| 13 | 83716488 | 44 | + | + | IR | NT | + |
| 14 | 83718334 | 39 | + | + | NIR | NT | + |
| 15 | 83716254 | 55 | + | + | NIR | NT | + |
| 16 | 83720933 | 58 | + | + | IR | NT | + |
| 17 | 83718989 | 55 | + | + | U | NT | + |
| 18 | 83717287 | 19 | ND | + | NIR | NT | + |
| 19 | 83718020 | 8.5 | ND | ND | U | NT | ND |
| 20 | 83718178 | 36 | ND | + | U | NT | + |
| 21 | 83718226 | 42 | + | + | IR | NT | + |
| 22 | 83719074 | 56 | + | + | IR | NT | + |
| 23 | 83718695 | 85 | ND | ND | U | NT | ND |
| 24 | 83717289 | 78 | ND | ND | U | NT | ND |
| 25 | 83720836 | 43 | + | ND | IR | NT | + |

[a]ID#, unique number assigned to each polypeptide for tracking purposes.

[b]Molecular weight (predicted).

[c]A protein is considered to be present (+) under iron restriction if detected by 2D gel/mass spectroscopy or in iTRAQ. ND, not detected.

[d]Iron regulation was determined using criteria described in Example 5. IR, iron-regulated; NIR, non-iron regulated; U, iron regulation uncertain.

[e]Immunogenicity of a single protein was determined by antibody and/or T cell recall responses to a purified recombinant protein in mice immunized with either the iron-restricted extract or a mix of recombinant proteins.

NT, not tested.

[f]protection is considered positive (+) if the protein was determined to be present in the immunizing extract for experiments shown in FIGS. 3 and 4, either by mass spectroscopy, in trial 3 by iTRAQ, or through production of antibodies to recombinant proteins from mice immunized with the protective extract vaccine.

A polypeptide as described herein also can be designed to provide one or more additional sequences such as, for example, the addition of coding sequences for added C-terminal and/or N-terminal amino acids that may facilitate purification by trapping on columns or use of antibodies. Such tags include, for example, histidine-rich tags that allow purification of polypeptides on nickel columns. Such gene modification techniques and suitable additional sequences are well known in the molecular biology arts.

A polypeptide as described herein also may be designed so that certain amino acids at the C-terminal and/or N-terminal are deleted. For example, one difference between the amino acid sequences of SEQ ID NO:1 and SEQ ID NO:51 is that SEQ ID NO:51 possesses an N-terminal 17 amino acid addition that is not present in the reference polypeptide amino acid sequence of SEQ ID NO:1. Similar exemplary N-terminal additions, typically varying from about five amino acids to about 50 amino acids, are apparent when one compares, for example, the reference amino acid sequence of SEQ ID NO:101, SEQ ID NO:141, SEQ ID NO:189, SEQ ID NO:190, SEQ ID NO:59, or SEQ ID NO:107 with certain variant embodiments of the respective amino acid sequence. Other amino acids additions and/or deletions, at either the N-terminal or the C-terminal, are possible.

A "modification" of a polypeptide as described herein includes a polypeptide (or an analog thereof such as, e.g., a fragment thereof) that is chemically or enzymatically derivatized at one or more constituent amino acids. Such a modification can include, for example, a side chain modification, a backbone modification, an N-terminal modification, and/or a C-terminal modification such as, for example, acetylation, hydroxylation, methylation, amidation, and the attachment of a carbohydrate and/or lipid moiety, a cofactor, and the like, and combinations thereof. Modified polypeptides as described herein may retain the biological activity—such as, for example, immunological activity—of the unmodified polypeptide or may exhibit a reduced or increased biological activity compared to the unmodified polypeptide.

A polypeptide as described herein (including a biologically active analog thereof and/or a modification thereof) can include a native (naturally occurring), a recombinant, a chemically synthesized, or an enzymatically synthesized polypeptide. For example, a polypeptide as described herein may be prepared by isolating the polypeptide from a natural source or may be prepared recombinantly by conventional methods including, for example, preparation as fusion proteins in bacteria or other host cells.

A polypeptide expressed by a reference microbe can be obtained by growing the reference microbe under low metal conditions as described herein and the subsequent isolation of a polypeptide by the processes disclosed herein. Alternatively, a polypeptide expressed by a reference microbe can be obtained by identifying coding regions expressed at higher levels when the microbe is grown in low metal conditions—i.e., metal-regulated. A metal-regulated coding region can be cloned and expressed, and the expressed metal-regulated polypeptide may be identified by the processes described herein. A candidate polypeptide can be isolatable from a microbe or identified from a microbe, preferably a gram negative microbe, more preferably, a member of the family Burkholderiaceae, preferably, *Burkholderia* spp. such as, for example, *B. thailandensis, B. mallei, B. pseudomallei, B. cenocepacia*, or *B. multivorans*. A candidate polypeptide may also be produced using enzymatic or chemical techniques.

Mass Fingerprint Similarity

A candidate polypeptide may be evaluated by mass spectrometric analysis to determine whether the candidate polypeptide has a mass fingerprint similar to one of the polypeptides expressed by a reference microbe and referred to above by molecular weight. Typically, the candidate polypeptide can be isolated, for instance by resolving the candidate polypeptide by gel electrophoresis and excising the portion of the gel containing the candidate polypeptide. Any gel electrophoresis method that separates polypeptides based on differing characteristics can be used, including one-dimensional or two-dimensional gel electrophoresis, as well as liquid chromatographic separation based on, for instance, hydrophobicity, pI, or size. The candidate polypeptide can be fragmented, for instance by digestion with a protease. Preferably, the protease can cleave the peptide bond on the carboxy-terminal side of the amino acid lysine and the amino acid arginine, except when the amino acid following the lysine or the arginine is a proline. An example of such a protease is trypsin. Methods for digesting a polypeptide with trypsin are routine and known in the art. An example of such a method is disclosed in Example 3.

Methods for the mass spectrometric analysis of polypeptides are routine and known in the art and include, but are not limited to, nano high-pressure liquid chromatography electrospray tandem mass spectrometry (nanoLC-EDI-MS/MS). Often, when a candidate polypeptide is analyzed by mass spectroscopy, both the candidate polypeptide and the reference polypeptide—i.e., the polypeptide from the reference microbe—are prepared and analyzed together, thereby decreasing any potential artifacts resulting from differences in sample handling and running conditions. Preferably, all reagents used to prepare and analyze the two polypeptides are the same. For instance, the polypeptide from the reference microbe and the candidate polypeptide are isolated under substantially the same conditions, fragmented under substantially the same conditions, and analyzed by nanoLC-EDI-MS/MS on the same machine under substantially the same conditions. A candidate polypeptide may be considered to be "structurally similar" to a reference polypeptide if it exhibits a mass fingerprint possessing at least 80%, at least 90%, at least 95%, or substantially all of the m/z values present in the spectrum of the reference microbe polypeptide and above the background level of noise are also present in the spectrum of the candidate polypeptide. (See, e.g., United States Patent Application Publication No. 2006/0233824 A1).

In another aspect, a polypeptide can be considered to be a polypeptide as described herein if it has a molecular weight of a reference polypeptide described herein and has a mass fingerprint that includes a subpopulation including at least a specified percentage of the polypeptide fragments of the mass fingerprint of the reference polypeptide.

The mass fingerprint of a candidate polypeptide can be determined by a mass spectrometric method, for instance by nanoLC-EDI-MS/MS. The mass fingerprint of a candidate polypeptide will generally have additional polypeptide fragments and, therefore, can have additional m/z values other than those identified in any particular analysis. When the candidate polypeptide is being compared to a polypeptide as described herein, the candidate polypeptide can be isolatable from a microbe, preferably a gram negative microbe, more preferably, a member of the family Burkholderiaceae, preferably, *Burkholderia* spp. such as, for example, *B. thailandensis, B. mallei, B. pseudomallei, B. cenocepacia*, or *B. multivorans*.

Metal-regulated candidate polypeptides can be obtained by growing a microbe under low metal conditions and subsequently isolating a polypeptide by the processes described herein. Non-metal-regulated candidate polypeptides can be obtained by growing a microbe under low metal conditions or high metal conditions and subsequently isolating a polypeptide by the processes described herein. Alternatively, a candidate polypeptide can be obtained by recombinant expression of a polynucleotide that encodes the candidate polypeptide.

Polynucleotide Sequence Similarity and Polynucleotide Sequence Identity

Polypeptides as described herein also may be identified in terms of the polynucleotide that encodes the polypeptide. Thus, this disclosure provides polynucleotides that encode a polypeptide as described herein or hybridize, under standard hybridization conditions, to a polynucleotide that encodes a polypeptide as described herein, and the complements of such polynucleotide sequences.

As used herein, reference to a polynucleotide as described herein and/or reference to the nucleic acid sequence of one or more SEQ ID NOs can include polynucleotides having a sequence identity of at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to an identified reference polynucleotide sequence.

In this context, "sequence identity" refers to the identity between two polynucleotide sequences. Sequence identity is generally determined by aligning the bases of the two polynucleotides (for example, aligning the nucleotide sequence of the candidate sequence and a nucleotide sequence that includes, for example, the nucleotide sequence of SEQ ID NO:26 or SEQ ID NO:27) to optimize the number of identical nucleotides along the lengths of their sequences; gaps in either or both sequences are permitted in making the alignment in order to optimize the number of shared nucleotides, although the nucleotides in each sequence must nonetheless remain in their proper order. A candidate sequence is the sequence being compared to a known sequence—e.g., a nucleotide sequence that includes the nucleotide sequence of, for example, SEQ ID NO:76 or SEQ ID NO:77. For example, two polynucleotide sequences can be compared using the Blastn program of the BLAST 2 search algorithm, as described by Tatiana et al., (*FEMS Microbiol Lett.*, 174:247-250 (1999)), and available on the world wide web at ncbi.nlm.nih.gov/BLAST/. The default values for all BLAST 2 search parameters may be used, including reward for match=1, penalty for mismatch=−2, open gap penalty=5, extension gap penalty=2, gap x_dropoff=50, expect=10, wordsize=11, and filter on.

For example, a polynucleotide as described herein can include a polynucleotide that encodes a polypeptide commonly known as a TonB-dependent siderophore receptor. One embodiment of this polynucleotide is reflected in the polynucleotide sequence of SEQ ID NO:26. Variant embodiments are reflected in the polynucleotide sequences of SEQ ID NO:76, SEQ ID NO:121, SEQ ID NO:165, and SEQ ID NO:212.

For example, a polynucleotide as described herein can include a polynucleotide that encodes a polypeptide commonly known as resistance-nodulation-cell division (RND) superfamily efflux system outer membrane lipoprotein. One embodiment of this polynucleotide is reflected in the polynucleotide sequence of SEQ ID NO:27. Variant embodiments are reflected in the polynucleotide sequences of SEQ ID NO:77, SEQ ID NO:122, SEQ ID NO:166, and SEQ ID NO:213.

For example, a polynucleotide as described herein can include a polynucleotide that encodes a polypeptide commonly known as outer membrane ferric siderophore receptor. One embodiment of this polynucleotide is reflected in the polynucleotide sequence of SEQ ID NO:28. Variant embodiments are reflected in the polynucleotide sequences of SEQ ID NO:78, SEQ ID NO:167, and SEQ ID NO:214.

For example, a polynucleotide as described herein can include a polynucleotide that encodes a polypeptide commonly known as TonB-dependent heme/hemoglobin receptor family protein. One embodiment of this polynucleotide is reflected in the polynucleotide sequence of SEQ ID NO:29. Variant embodiments are reflected in the polynucleotide sequences of SEQ ID NO:79, SEQ ID NO:123, SEQ ID NO:168, and SEQ ID NO:215.

For example, a polynucleotide as described herein can include a polynucleotide that encodes a polypeptide commonly known as Fe(III) pyochelin receptor. One embodiment of this polynucleotide is reflected in the polynucleotide sequence of SEQ ID NO:30. Variant embodiments are reflected in the polynucleotide sequences of SEQ ID NO:80 and SEQ ID NO:169.

For example, a polynucleotide as described herein can include a polynucleotide that encodes a polypeptide commonly known as TonB-dependent siderophore receptor family protein. One embodiment of this polynucleotide is reflected in the polynucleotide sequence of SEQ ID NO:31. Variant embodiments are reflected in the polynucleotide sequences of SEQ ID NO:81, SEQ ID NO:124, and SEQ ID NO:170.

For example, a polynucleotide as described herein can include a polynucleotide that encodes a polypeptide commonly known as TonB-dependent copper receptor. One embodiment of this polynucleotide is reflected in the polynucleotide sequence of SEQ ID NO:32. Variant embodiments are reflected in the polynucleotide sequences of SEQ ID NO:82, SEQ ID NO:125, SEQ ID NO:171, and SEQ ID NO:216.

For example, a polynucleotide as described herein can include a polynucleotide that encodes a polypeptide commonly known as a TonB-dependent siderophore receptor. One embodiment of this polynucleotide is reflected in the polynucleotide sequence of SEQ ID NO:33. Variant embodiments are reflected in the polynucleotide sequences of SEQ ID NO:83, SEQ ID NO:126, SEQ ID NO:172, and SEQ ID NO:217.

For example, a polynucleotide as described herein can include a polynucleotide that encodes a polypeptide commonly known as an OmpA family protein. One embodiment of this polynucleotide is reflected in the polynucleotide sequence of SEQ ID NO:34. Variant embodiments are reflected in the polynucleotide sequences of SEQ ID NO:84, SEQ ID NO:127, SEQ ID NO:173, and SEQ ID NO:218.

For example, a polynucleotide as described herein can include a polynucleotide that encodes a polypeptide commonly known as OmpA family outer membrane protein. One embodiment of this polynucleotide is reflected in the polynucleotide sequence of SEQ ID NO:35. Variant embodiments are reflected in the polynucleotide sequences of SEQ ID NO:85, SEQ ID NO:128, SEQ ID NO:174, and SEQ ID NO:219.

For example, a polynucleotide as described herein can include a polynucleotide that encodes a polypeptide commonly known as OmpA family protein that differs from the OmpA family protein described above. One embodiment of this polynucleotide is reflected in the polynucleotide sequence of SEQ ID NO:36. Variant embodiments are reflected in the polynucleotide sequences of SEQ ID NO:86, SEQ ID NO:129, SEQ ID NO:175, and SEQ ID NO:220.

For example, a polynucleotide as described herein can include a polynucleotide that encodes a polypeptide commonly known as an outer membrane porin. One embodiment of this polynucleotide is reflected in the polynucleotide sequence of SEQ ID NO:37. Variant embodiments are reflected in the polynucleotide sequences of SEQ ID NO:87, SEQ ID NO:176, and SEQ ID NO:221.

For example, a polynucleotide as described herein can include a polynucleotide that encodes a polypeptide commonly known as an outer membrane porin that differs from the outer membrane porin described above. One embodiment of this polynucleotide is reflected in the polynucleotide sequence of SEQ ID NO:38. Variant embodiments are reflected in the polynucleotide sequences of SEQ ID NO:88, SEQ ID NO:130, SEQ ID NO:177, and SEQ ID NO:222.

For example, a polynucleotide as described herein can include a polynucleotide that encodes a polypeptide commonly known as an outer membrane porin that differs from the outer membrane porins described above. One embodiment of this polynucleotide is reflected in the polynucleotide sequence of SEQ ID NO:39. Variant embodiments are reflected in the polynucleotide sequences of SEQ ID NO:89, SEQ ID NO:131, SEQ ID NO:178, and SEQ ID NO:223.

For example, a polynucleotide as described herein can include a polynucleotide that encodes a polypeptide commonly known as an outer membrane porin that differs from the outer membrane porins described above. One embodiment of this polynucleotide is reflected in the polynucleotide sequence of SEQ ID NO:40. Variant embodiments are reflected in the polynucleotide sequences of SEQ ID NO:90, SEQ ID NO:132, SEQ ID NO:179, and SEQ ID NO:224.

For example, a polynucleotide as described herein can include a polynucleotide that encodes a polypeptide commonly known as a resistance-nodulation-cell division (RND) superfamily efflux system outer membrane lipoprotein. One embodiment of this polynucleotide is reflected in the polynucleotide sequence of SEQ ID NO:41. Variant embodiments are reflected in the polynucleotide sequences of SEQ ID NO:91, SEQ ID NO:180, and SEQ ID NO:225.

For example, a polynucleotide as described herein can include a polynucleotide that encodes a polypeptide commonly known as a resistance-nodulation-cell division (RND) superfamily efflux system outer membrane lipoprotein. One embodiment of this polynucleotide is reflected in the polynucleotide sequence of SEQ ID NO:42. Variant embodiments are reflected in the polynucleotide sequences of SEQ ID NO:92, SEQ ID NO:133, SEQ ID NO:181, and SEQ ID NO:226.

For example, a polynucleotide as described herein can include a polynucleotide that encodes a polypeptide commonly known as bacterioferritin (Bfr). One embodiment of this polynucleotide is reflected in the polynucleotide sequence of SEQ ID NO:43. Variant embodiments are reflected in the polynucleotide sequences of SEQ ID NO:93, SEQ ID NO:134, SEQ ID NO:182, and SEQ ID NO:227.

For example, a polynucleotide as described herein can include a polynucleotide that encodes a polypeptide commonly known as bacterioferritin-associated ferredoxin (Bfd). One embodiment of this polynucleotide is reflected in the polynucleotide sequence of SEQ ID NO:44. Variant embodiments are reflected in the polynucleotide sequences of SEQ ID NO:94, SEQ ID NO:135, SEQ ID NO:183, and SEQ ID NO:228.

For example, a polynucleotide as described herein can include a polynucleotide that encodes a polypeptide commonly known as dipeptide ABC transporter permease. One embodiment of this polynucleotide is reflected in the polynucleotide sequence of SEQ ID NO:45. Variant embodiments are reflected in the polynucleotide sequences of SEQ ID NO:95, SEQ ID NO:136, SEQ ID NO:184, and SEQ ID NO:229.

For example, a polynucleotide as described herein can include a polynucleotide that encodes a polypeptide commonly known as an outer membrane porin that differs from the outer membrane porins described above. One embodiment of this polynucleotide is reflected in the polynucleotide sequence of SEQ ID NO:46. Variant embodiments are reflected in the polynucleotide sequences of SEQ ID NO:96, SEQ ID NO:185, and SEQ ID NO:230.

For example, a polynucleotide as described herein can include a polynucleotide that encodes a polypeptide commonly known as a resistance-nodulation-cell division (RND) superfamily efflux system outer membrane lipoprotein. One embodiment of this polynucleotide is reflected in the polynucleotide sequence of SEQ ID NO:47. Variant embodiments are reflected in the polynucleotide sequences of SEQ ID NO:97, SEQ ID NO:137, and SEQ ID NO:231.

For example, a polynucleotide as described herein can include a polynucleotide that encodes a polypeptide commonly known as a TonB-dependent receptor. One embodiment of this polynucleotide is reflected in the polynucleotide sequence of SEQ ID NO:48. Variant embodiments are reflected in the polynucleotide sequences of SEQ ID NO:98, SEQ ID NO:138, SEQ ID NO:186, and SEQ ID NO:232.

For example, a polynucleotide as described herein can include a polynucleotide that encodes a polypeptide commonly known as a TonB-dependent receptor. One embodiment of this polynucleotide is reflected in the polynucleotide sequence of SEQ ID NO:49. Variant embodiments are reflected in the polynucleotide sequences of SEQ ID NO:99, SEQ ID NO:139, SEQ ID NO:187, and SEQ ID NO:233.

For example, a polynucleotide as described herein can include a polynucleotide that encodes a polypeptide commonly known as resistance-nodulation-cell division (RND) superfamily efflux transporter MFP subunit. One embodiment of this polynucleotide is reflected in the polynucleotide sequence of SEQ ID NO:50. Variant embodiments are reflected in the polynucleotide sequences of SEQ ID NO:100, SEQ ID NO:140, SEQ ID NO:188, and SEQ ID NO:234.

Finally, a polynucleotide as described herein can include any polynucleotide that encodes a polypeptide as described herein. Thus, the nucleotide sequence of the polynucleotide may be deduced from the amino acid sequence that is to be encoded by the polynucleotide.

This disclosure also provides whole cell preparations of a microbe, where the microbe expresses one or more of the polypeptides described herein. The cells present in a whole cell preparation may be inactivated such that the cells cannot replicate but the immunological activity of the polypeptides as described herein expressed by the microbe is maintained. Typically, the cells may be killed by exposure to agents such as glutaraldehyde, formalin, or formaldehyde.

Compositions

A composition as described herein may include at least one isolated polypeptide described herein, or a number of polypeptides that is an integer greater than one (e.g., at least two, at least three, at least four). Unless a specific level of sequence similarity and/or identity is expressly indicated herein (e.g., at least 80% sequence similarity, at least 90% sequence identity, etc.), reference to the amino acid sequence of an identified SEQ ID NO includes variants having the levels of sequence similarity and/or the levels of sequence identity described herein in the section headed "Polypeptide sequence similarity and polypeptide sequence identity."

A recombinantly-produced polypeptide may be expressed from a vector that permits expression of the polypeptide when the vector is introduced into an appropriate host cell. A host cell may be constructed to produce one or more recombinantly-produced polypeptides as described herein and, therefore, can include one more vectors that include at least one polynucleotide that encodes a polypeptide as described herein. Thus, each vector can include one or more polynucleotides as described herein—i.e., a polynucleotide that encodes a polypeptide as described herein.

Certain compositions such as, for example, those including recombinantly-produced polypeptides, can include a maximum number of polypeptides. In some embodiments, the maximum number of polypeptides can refer to the maximum total number of polypeptides. Certain compositions can include, for example, no more than 50 polypeptides such as, for example, no more than 40 polypeptides, no more than 30 polypeptides, no more than 25 polypeptides, no more than 20 polypeptides, no more than 15 polypeptides, no more than 10 polypeptides, no more than eight polypeptides, no more than seven polypeptides, no more than six polypeptides, no more than five polypeptides, no more than four polypeptides, no more than three polypeptides, no more than two polypeptides, or no more than one polypeptide. In other embodiments, a maximum number of recombinantly-produced polypeptides may be specified in a similar manner. In still other embodiments, a maximum number of nonrecombinantly-produced polypeptides may be specified in a similar manner.

A composition can include polypeptides isolatable from one microbe, or can be isolatable from a combination of two or more microbes. For instance, a composition can include polypeptides isolatable from two or more *Burkholderia* spp., or from a *Burkholderia* spp. and a different microbe that is not a member of the genus *Burkholderia*. In certain embodiments, a composition can include a whole cell preparation in which the whole cell expresses one or more of the polypeptides as described herein. In some of these embodiments, the whole cell can be a *Burkholderia* spp. In some embodiments, a composition can include whole cell preparations from two, three, four, five, or six strains.

Optionally, a polypeptide as described herein can be covalently bound or conjugated to a carrier polypeptide to improve the immunological properties of the polypeptide. Useful carrier polypeptides are known in the art. The chemical coupling of polypeptides as described herein can be carried out using known and routine methods. For instance, various homobifunctional and/or heterobifunctional cross-linker reagents such as bis(sulfosuccinimidyl) suberate, bis (diazobenzidine), dimethyl adipimidate, dimethyl pimelimidate, dimethyl superimidate, disuccinimidyl suberate, glutaraldehyde, m-maleimidobenzoyl-N-hydroxysuccinimide, sulfo-m-maleimidobenzoyl-N-hydroxysuccinimide, sulfosuccinimidyl 4-(N-maleimidomethyl) cycloheane-1-carboxylate, sulfosuccinimidyl 4-(p-maleimido-phenyl) butyrate and (1-ethyl-3-(dimethyl-aminopropyl) carbodiimide can be used (see, for instance, Harlow and Lane, Antibodies, A Laboratory Manual, generally and Chapter 5, Cold Spring Harbor Laboratory, Cold Spring Harbor, New York, N.Y. (1988)).

The compositions as described herein optionally further include a pharmaceutically acceptable carrier. "Pharmaceutically acceptable" refers to a diluent, carrier, excipient, salt, etc., that is compatible with the other ingredients of the composition, and not deleterious to the recipient thereof. Typically, the composition includes a pharmaceutically acceptable carrier when the composition is used as described herein. Exemplary pharmaceutically acceptable carriers include buffer solutions and generally exclude blood products such as, for example, whole blood and/or plasma. The compositions as described herein may be formulated in pharmaceutical preparations in a variety of forms adapted to the chosen route of administration, including routes suitable for stimulating an immune response to an antigen. Thus, a composition as described herein can be administered via known routes including, for example, oral; parenteral including intradermal, transcutaneous and subcutaneous; intramuscular, intravenous, intraperitoneal, etc. and topically, such as, intranasal, intrapulmonary, intramammary, intravaginal, intrauterine, intradermal, transcutaneous and rectally, etc. It is foreseen that a composition can be administered to a mucosal surface, such as by administration to the nasal or respiratory mucosa (e.g., via a spray or aerosol), in order to stimulate mucosal immunity, such as production of secretory IgA antibodies, throughout the animal's body.

A composition as described herein can also be administered via a sustained or delayed release implant. Implants suitable for use according to the invention are known and include, for example, those disclosed in International Publication No. WO 2001/037810 and/or International Publication No. WO 1996/001620. Implants can be produced at sizes small enough to be administered by aerosol or spray. Implants also can include nanospheres and microspheres.

A composition as described herein may be administered in an amount sufficient to treat certain conditions as described herein. The amount of polypeptides or whole cells present in a composition as described herein can vary. For instance, the dosage of polypeptides can be between 0.01 micrograms (μg) and 300 mg, typically between 0.1 mg and 10 mg. When the composition is a whole cell preparation, the cells can be present at a concentration of, for instance, $10^2$ bacteria/ml, $10^3$ bacteria/ml, $10^4$ bacteria/ml, $10^5$ bacteria/ml, $10^6$ bacteria/ml, $10^7$ bacteria/ml, $10^8$ bacteria/ml, or $10^9$ bacteria/ml. For an injectable composition (e.g. subcutaneous, intramuscular, etc.) the polypeptides may be present in the composition in an amount such that the total volume of the composition administered is 0.5 ml to 5.0 ml, typically 1.0 to 2.0 ml. When the composition is a whole cell preparation, the cells are preferably present in the composition in an amount that the total volume of the composition administered is 0.5 ml to 5.0 ml, typically 1.0 to 2.0 ml. The amount administered may vary depending on various factors including, but not limited to, the specific polypeptides chosen, the weight, physical condition and age of the animal, and the route of administration. Thus, the absolute weight of the polypeptide included in a given unit dosage form can vary widely, and depends upon factors such as the species, age, weight and physical condition of the animal, as well as the method of administration. Such factors can be determined by one of skill in the art. Other examples of dosages suitable for the invention are disclosed in U.S. Pat. No. 6,027,736.

The formulations may be conveniently presented in unit dosage form and may be prepared by methods well known in the art of pharmacy. Methods of preparing a composition with a pharmaceutically acceptable carrier include the step of bringing the active compound (e.g., a polypeptide or whole cell as described herein) into association with a carrier that constitutes one or more accessory ingredients. In general, the formulations are prepared by uniformly and intimately bringing the active compound into association with a liquid carrier, a finely divided solid carrier, or both, and then, if necessary, shaping the product into the desired formulations.

A composition including a pharmaceutically acceptable carrier also can include an adjuvant. An "adjuvant" refers to an agent that can act in a nonspecific manner to enhance an immune response to a particular antigen, thus potentially reducing the quantity of antigen necessary in any given immunizing composition, and/or the frequency of injection necessary in order to generate an adequate immune response to the antigen of interest. Adjuvants may include, for example, IL-1, IL-2, emulsifiers, muramyl dipeptides, dimethyl dioctadecyl ammonium bromide (DDA), avridine, aluminum hydroxide, oils, saponins, alpha-tocopherol, polysaccharides, emulsified paraffins (including, for instance, those available from under the tradename EMULSIGEN from MVP Laboratories, Ralston, Nebr.), ISA-70, RIBI and other substances known in the art. It is expected that polypeptides as described herein will have immunoregulatory activity and that such polypeptides may be used as adjuvants that directly act as T cell and/or B cell activators or act on specific cell types that enhance the synthesis of various cytokines or activate intracellular signaling pathways. Such polypeptides are expected to augment the immune response to increase the protective index of the existing composition.

In another embodiment, a composition as described herein including a pharmaceutically acceptable carrier can include a biological response modifier, such as, for example, IL-2, IL-4 and/or IL-6, TNF, IFN-α, IFN-γ, and other cytokines that effect immune cells. An immunizing composition can also include other components known in the art such as an antibiotic, a preservative, an anti-oxidant, or a chelating agent.

Methods of Making

This disclosure also provides methods for obtaining the polypeptides described herein. The polypeptides and whole cells as described herein may be isolatable from a member of the family Burkholderiaceae, preferably, *Burkholderia* spp. such as, for example, *B. thailandensis*, *B. mallei*, *B. pseudomallei*, *B. cenocepacia*, or *B. multivorans*. Other gram negative microbes from which polypeptides can be isolated include, for example, *Achromobacter* spp., *Ralstonia* spp., *Pseudomonas* spp., *Bordetella* spp., and *Acinetobacter* spp. Microbes useful for obtaining polypeptides as described herein and making whole cell preparations are commercially available from a depository such as American Type Culture Collection (ATCC). In addition, such microbes are readily obtainable by techniques routine and known to the art. The microbes may be derived from an infected animal as a field isolate, and used to obtain the polypeptides and/or the whole cell preparations as described herein, or stored for future use, for example, in a frozen repository at from −20° C. to −95° C., or from −40° C. to −50° C., in bacteriological media containing 20% glycerol, and other like media.

When a polypeptide as described herein is to be obtained from a microbe, the microbe can be incubated under low metal conditions. As used herein, the phrase "low metal conditions" refers to an environment, typically bacteriological media, that contains an amount of a free metal that causes a microbe to express metal-regulated polypeptides at a detectable level. As used herein, the phrase "high metal conditions" refers to an environment that contains an amount of a free metal that causes a microbe to express a metal-regulated polypeptide at a decreased level compared to expression of the metal-regulated polypeptide under low metal conditions. In some cases, "high metal conditions" can refer to an environment that causes a cell to fail to express one or more of the metal-regulated polypeptides described herein at a detectable level.

In some cases, "high metal conditions" can include a metal-rich natural environment and/or culture in a metal-rich medium without a metal chelator. In contrast, in some cases, "low metal conditions" can include culture in a medium that includes a metal chelator, as described in more detail below. Metals are those present in the periodic table under Groups 1 through 17 (IUPAC notation; also referred to as Groups I-A, II-A, III-B, IV-B, V-B, VI-B, VII-B, VIII, I-B, II-B, III-A, IV-A, V-A, VI-A, and VII-A, respectively, under CAS notation). Preferably, metals are those in Groups 2 through 12, more preferably, Groups 3-12. Even more preferably, the metal is iron, zinc, copper, magnesium, nickel, cobalt, manganese, molybdenum, or selenium, most preferably, iron.

Low metal conditions are generally the result of the addition of a metal chelating compound to a bacteriological medium, the use of a bacteriological medium that contains low amounts of a metal, or the combination thereof. High metal conditions are generally present when a chelator is not present in the medium, when a metal is added to the medium, or the combination thereof. Examples of metal chelators include natural and synthetic compounds. Examples of natural compounds include plant phenolic compounds, such as flavenoids. Examples of flavenoids include the copper chelators catechin and naringenin, and the iron chelators myricetin and quercetin. Examples of synthetic copper chelators include, for instance, tetrathiomolybdate, and examples of synthetic zinc chelators include, for instance, N,N,N',N'-Tetrakis (2-pyridylmethyl)-ethylene diamine Examples of synthetic iron chelators include 2,2'-dipyridyl (also referred to in the art as θ,θ'-bipyridyl), 8-hydroxyquinoline, ethylenediamine-di-O-hydroxyphenylacetic acid (EDDHA), desferrioxamine methanesulphonate (desferol), transferrin, lactoferrin, ovotransferrin, biological siderophores, such as, the catecholates and hydroxamates, and citrate. An example of a general divalent cation chelator is CHELEX resin. Preferably, 2,2'-dipyridyl is used for the chelation of iron. Typically, 2,2'-dipyridyl is added to the media at a concentration of at least 300 micrograms/milliliter (μg/ml), at least 600 μg/ml, or at least 900 μg/ml. High levels of 2,2'-dipyridyl can be, for example, 1200 μg/ml, 1500 μg/ml, or 1800 μg/ml.

The *B. thailandensis* genome encodes a ferric uptake regulator (Fur) homolog. The Fur protein controls the uptake of metal ions by regulating the expression of iron receptors such as the siderophore receptor proteins in response to iron limitation. It also plays a role in oxidative stress resistance and virulence. It is expected that a gram negative organism, preferably, a *Burkholderia* spp., with a mutation in the fur coding region will result in the constitutive expression of many, if not all, of the metal-regulated polypeptides as described herein. The production of a fur mutation in a gram negative, preferably, a *Burkholderia* spp., can be produced using routine methods including, for instance, transposon, chemical, or site-directed mutagenesis useful for generating gene missense or knock-out mutations in gram negative bacteria.

The medium used to incubate the microbe and the volume of media used to incubate the microbe can vary. When a microbe is being evaluated for the ability to produce one or more of the polypeptides described herein, the microbe can be grown in a suitable volume, for instance, 10 milliliters to 1 liter of medium. When a microbe is being grown to obtain polypeptides for use in, for instance, administration to animals, the microbe may be grown in a fermenter to allow the isolation of larger amounts of polypeptides. Methods for growing microbes in a fermenter are routine and known to the art. The conditions used for growing a microbe preferably include a metal chelator, more preferably an iron chelator, for instance 2,2'-dipyridyl, a pH of between 6.5 and 7.5, preferably between 6.9 and 7.1, and a temperature of 37° C.

In some aspects of the invention, a microbe may be harvested after growth. Harvesting includes concentrating the microbe into a smaller volume and suspending in a media different than the growth media. Methods for concentrating a microbe are routine and known in the art, and include, for example, filtration or centrifugation. Typically, the concentrated microbe is suspended in an appropriate buffer. An example of a buffer that can be used contains Tris-base (7.3 grams/liter), at a pH of 8.5. Optionally, the final buffer also minimizes proteolytic degradation. This can be accomplished by having the final buffer at a pH of greater than 8.0, preferably, at least 8.5, and/or including one or more proteinase inhibitors (e.g., phenylmethanesulfonyl fluoride). Optionally, the concentrated microbe is frozen at −20° C. or below until disrupted.

When the microbe is to be used as a whole cell preparation, the harvested cells may be processed using routine and known methods to inactivate the cells. Alternatively, when a microbe is to be used to prepare polypeptides as described herein, the microbe may be disrupted using chemical, physical, or mechanical methods routine and known to the art, including, for example, boiling, French press, sonication, digestion of peptidoglycan (for instance, by digestion with lysozyme), or homogenization. An example of a suitable device useful for homogenization is a model C500-B AVESTIN homogenizer, (Avestin Inc., Ottawa, Canada). As used herein, "disruption" refers to the breaking up of the cell. Disruption of a microbe can be measured by methods that are routine and known to the art, including, for instance, changes in optical density. Typically, a microbe is subjected to disruption until the percent transmittance is increased by 20% when a 1:100 dilution is measured. When physical or mechanical methods are used, the temperature during disruption is typically kept low, preferably at 4° C., to further minimize proteolytic degradation. When chemical methods are used the temperature may be increased to optimize for the cell disruption. A combination of chemical, physical, and mechanical methods may also be used to solubilize the cell wall of microbe. As used herein, the term "solubilize" refers to dissolving cellular materials (e.g., polypeptides, nucleic acids, carbohydrates) into the aqueous phase of the buffer in which the microbe was disrupted, and the formation of aggregates of insoluble cellular materials. Without intending to be limited by theory, the conditions for solubilization are believed to result in the aggregation of polypeptides as described herein into insoluble aggregates that are large enough to allow easy isolation by, for instance, centrifugation.

The insoluble aggregates that include one or more of the polypeptides as described herein may be isolated by methods that are routine and known to the art. Preferably, the insoluble aggregates are isolated by centrifugation. Typically, centrifugation of polypeptides, such as membrane polypeptides, can be accomplished by centrifugal forces of 100,000×g. The use of such centrifugal forces requires the use of ultracentrifuges, and scale-up to process large volumes of sample is often difficult and not economical with these types of centrifuges. The methods described herein provide for the production of insoluble aggregates large enough to allow the use of continuous flow centrifuges, for instance T-1 Sharples (Alfa Laval, Inc., Richmond, Va.), which can be used with a flow rate of 250 ml/minute at 17 psi at a centrifugal force of 46,000×g to 60,000×g. Other large scale centrifuges can be used, such as the tubular bowl, chamber, and disc configurations. Such centrifuges are routinely used and known in the art, and are commercially available from such manufactures as Pennwalt, Ltd., GEA Westfalia Separator Division (GEA Mechanical Equipment US, Inc.), or Alpha Laval, Inc.

The final harvested proteins can be washed and/or dialyzed against an appropriate buffer using conventional methods such as, for example, diafiltration, precipitation, hydrophobic chromatography, ion-exchange chromatography, affinity chromatography, or ultra-filtration, followed by washing the polypeptides, for instance, in alcohol, by diafiltration. After isolation, the polypeptides suspended in buffer and stored at low temperature, for instance, −20° C. or below.

In those aspects as described herein where a whole cell preparation is to be made, after growth a microbe can be killed with the addition of an agent such as glutaraldehyde, formalin, or formaldehyde, at a concentration sufficient to inactivate the cells in the culture. For instance, formalin can be added at a concentration of 0.3% (vol:vol). After a period of time sufficient to inactivate the cells, the cells can be harvested by, for instance, diafiltration and/or centrifugation, and washed.

In other aspects, an isolated polypeptide as described herein may be prepared recombinantly. When prepared recombinantly, a polynucleotide encoding the polypeptide may be identified and cloned into an appropriate expression host as described below in Example 6. The recombinant expression host may be grown in an appropriate medium, disrupted, and the polypeptides isolated as described above.

Methods of Use

In another aspect, this disclosure further provides methods of using the compositions as described herein. The methods include administering to an animal an effective amount of a composition as described herein. The animal can be, for instance, avian (including, for instance, chickens or turkeys), bovine (including, for instance, cattle), caprine (including, for instance, goats), ovine (including, for instance, sheep), porcine (including, for instance, swine), bison (including, for instance, buffalo), equine (including, for instance, horses), a companion animal (including, for instance, dogs or cats), members of the family Cervidae (including, for instance, deer, elk, moose, caribou and reindeer), or human.

In some aspects, the methods may further include additional administrations (e.g., one or more booster administrations) of the composition to the animal to enhance or stimulate a secondary immune response. A booster can be administered at a time after the first administration, for instance, one to eight weeks, preferably two to four weeks, after the first administration of the composition. Subsequent boosters can be administered one, two, three, four, or more times annually. Without intending to be limited by theory, it is expected that in some aspects as described herein annual boosters will not be necessary, as an animal will be challenged in the field by exposure to microbes expressing polypeptides present in the compositions having epitopes that are identical to or structurally related to epitopes present on polypeptides of the composition administered to the animal.

In one embodiment, the method can involve making antibody, for instance by inducing the production of antibody in an animal or by recombinant techniques. As used herein, the term "antibody"—when not preceded by a definite or indefinite article—can be used generically to refer to any preparation that includes at least one molecular species of immunoglobulin or a fragment (e.g., scFv, Fab, F(ab')$_2$ or Fv or other modified fragment) thereof. Therefore, "antibody" can generically include one or more monoclonal antibodies and/or a polyclonal antibody preparation. Antibody produced by the method can include antibody that specifically binds at least one polypeptide present in the composition. In this context, an "effective amount" is an amount effective to result in the production of antibody in the animal. Methods for determining whether an animal has produced antibody that specifically binds a polypeptide present in a composition can be determined as described herein. This disclosure therefore further provides antibody that specifically binds to a polypeptide as described herein, and compositions including such antibody.

The method may be used to produce antibody that specifically binds to a polypeptide expressed by a microbe other than the microbe from which the polypeptide of the composition were isolated. As used herein, antibody that can "specifically bind" a polypeptide is antibody that interacts with the epitope of the antigen that induced the synthesis of the antibody, or interacts with a structurally related epitope. At least some of the polypeptides present in the compositions as described herein typically include epitopes that are conserved in the polypeptides of different species and different genera of microbes. Accordingly, antibody produced using a composition derived from one microbe is expected to bind to polypeptides expressed by other microbes and provide broad spectrum protection against gram negative organisms. Examples of gram negative microbes to which the antibody may specifically bind are Burkholderiaceae, preferably, *Burkholderia* spp. such as, for example, *B. thailandensis, B. mallei, B. pseudomallei, B. cenocepacia,* or *B. multivorans*. Therefore, antibody produced using a composition of polypeptides as described herein may be used to identify and characterize polypeptides as described herein independent of the origin, source, and/or manner of obtaining the polypeptide.

In another aspect, this disclosure provides the use of such antibody to target a microbe expressing a polypeptide as described herein or a polypeptide having an epitope structurally related to an epitope present on a polypeptide as described herein. A compound can be covalently bound to an antibody, where the compound can be, for instance, a toxin. Likewise, such compounds can be covalently bound to a bacterial siderophore to target the microbe. The chemical coupling or conjugation of an antibody as described herein, or a portion thereof (such as a Fab fragment), can be carried out using known and routine methods.

In another aspect, this disclosure provides methods for treating an infection in an animal, including a human, caused by a gram negative microbe, preferably by a member of the family Burkholderiaceae, preferably, *Burkholderia* spp. such as, for example, *B. thailandensis, B. mallei, B. pseudomallei, B. cenocepacia*, or *B. multivorans*. As used herein, the term "infection" refers to the presence of a gram negative microbe in an animal's body, which may or may not be clinically apparent. An animal with an infection by a member of the genus *Burkholderia* that is not clinically apparent is often referred to as an asymptomatic carrier.

Treating an infection can be prophylactic or, alternatively, therapeutic—in this context, treatment after a subject manifests one or more indication of infection by a microbe. Generally, treatment that is prophylactic—in this context, initiated before a subject is infected by a microbe or while an infection remains subclinical—is referred to herein as treatment of a subject that is "at risk" of infection. As used herein, the term "at risk" refers to an animal that may or may not actually possess the described risk—in this context, an animal that may or may not be infected by a particular microbe. Thus, typically, an animal "at risk" of infection by a microbe is an animal present in an area where animals have been identified as infected by the microbe and/or is likely to be exposed to the microbe even if the animal has not yet manifested any detectable indication of infection by the microbe and regardless of whether the animal may harbor a subclinical amount of the microbe. Accordingly, administration of a composition can be performed before, during, or after the animal has first contact with the microbe. Treatment initiated after the animal's first contact with the microbe may result in decreasing the severity of symptoms and/or clinical signs of infection by the microbe, completely removing the microbe, and/or decreasing the likelihood of experiencing a clinically evident infection compared to an animal to which the composition is not administered. The method includes administering an effective amount of the composition as described herein to an animal having, or at risk of having, an infection caused by a gram negative microbe, and determining whether the number of microbes causing the infection has decreased. In this context, an "effective amount" is an amount effective to reduce the number of the specified microbes in an animal or reduce the likelihood that the animal experiences a clinically-evident infection compared to an animal to which the composition is not administered. Methods for determining whether an infection is caused by a gram negative microbe are routine and known in the art, as are methods for determining whether the infection has decreased.

In another aspect, the present invention is directed to methods for treating one or more symptoms or clinical signs of certain conditions in an animal that may be caused by infection by a gram negative microbe, preferably by a member of the family Burkholderiaceae, preferably, *Burkholderia* spp. such as, for example, *B. thailandensis, B. mallei, B. pseudomallei, B. cenocepacia*, or *B. multivorans*. The method includes administering an effective amount of a composition as described herein to an animal having or at risk of having a condition, or exhibiting symptoms and/or clinical signs of a condition, and determining whether at least one symptom and/or clinical sign of the condition is changed, preferably, reduced.

Melioidosis caused by *B. pseudomallei* tends to be more prevalent in people during the fourth and fifth decades of life, especially among those who have other comorbidities such as diabetes, alcoholism, immunosuppression, and renal failure. Melioidosis may be transmitted through direct skin contact with contaminated soil or water, ingestion of contaminated water, inhalation of dust contaminated with the bacterium, sexual contact, or intravenous drug use. Human-to-human transmission is rare but has been documented. The cutaneous form results in local infection with ulceration and swollen lymph glands. General symptoms include fever, rigors, night sweats, myalgia, anorexia, and headache. Additional symptoms are dependent on the route of exposure but may include chest pain, cough, photophobia, lacrimation, and diarrhea. Physical findings may include fever, cervical adenopathy, pustular skin lesions, hepatomegaly, or splenomegaly. During primary melioidosis, patients may experience severe urticaria. The chronic form may involve multiple abscesses that affect the liver, spleen, skin, or muscles, and may reactivate many years after the primary infection.

The pulmonary form of melioidosis may be manifest as pneumonia, pulmonary abscesses, and pleural effusions. Cutaneous abscesses may also develop and can take months to appear. Those who develop septicemia may develop respiratory distress, headaches, fever, diarrhea, pus-filled skin lesions, and abscesses throughout the body. Pustules often occur in association with regional lymphadenitis, cellulitis, or lymphangitis. Specifically, septicemia, high fever, and rigor are often present and may be accompanied by confusion, dyspnea, abdominal pain, muscle tenderness, pharyngitis, diarrhea, and jaundice. Although the foci of infection may be lungs or skin, once septicemia has developed, the disease spreads to the liver, spleen, kidney, brainstem, and parotid gland, leading to acidosis and shock with a high mortality rate exceeding 90% and death occurring within 24-48 hours.

*B. mallei* is the causative agent of glanders, which occurs primarily in horses and other solipeds. *B. mallei* is highly virulent and exhibits a pathophysiology in humans that is similar to glanders, where the clinical symptoms are similar to melioidosis as described above. Transmission is through direct skin or mucous membrane contact with infected animal tissues. Human-to-human transmission is possible and has been reported. Septicemia may include cutaneous, hepatic, and splenic involvement and is usually fatal within 7-10 days. The chronic form may involve multiple abscesses that affect the liver, spleen, skin, or muscles.

The *Burkholderia cepacia* complex is a group of at least 17 species responsible for opportunistic infections that are particularly problematic in diseases that cause impaired pulmonary function such as cystic fibrosis or chronic granulomatous disease. These organisms have also been a source of catheter-related infections in cancer patients and in those who are on hemodialysis. They have also been a source of skin and soft tissue infection, surgical wound infection, and genitourinary infection. The symptoms of pulmonary infection vary widely, ranging from asymptomatic infection to serious respiratory infections, especially in individuals that are immunocompromised, the young, the elderly, and people with lung disease. Symptoms are similar to other lung infections, with cough, wheezing shortness of breath, congestion, and fever. Thus, infection may be difficult to diagnose. Bacteria can persist in the lungs for years without symptoms.

Treatment of symptoms and/or clinical signs associated with these conditions can be prophylactic or, alternatively, therapeutic—in this context, treatment initiated after the subject exhibits one or more symptoms or clinical signs associated with a condition caused by infection by a gram negative microbe. As used herein, the term "symptom" refers to subjective evidence of disease or condition experienced by the patient and caused by infection by a microbe. As used herein, the term "clinical sign" or, simply, "sign" refers to objective evidence of disease or condition caused by infection by a microbe. Symptoms and/or clinical signs associated with conditions referred to herein and the evaluations of such symptoms are routine and known in the art. Treatment that is prophylactic—in this context, treatment that is initiated before a subject manifests symptoms or signs of a condition caused by a microbe—is referred to herein as treatment of a subject that is "at risk" of developing the condition. Thus, typically, an animal "at risk" of developing a condition is an animal present in an area where animals having the condition have been diagnosed and/or is likely to be exposed to a microbe causing the condition even if the animal has not yet manifested symptoms or signs of any condition caused by the microbe. Accordingly, administration of a composition can be performed before, during, or after the occurrence of the conditions described herein. Treatment initiated after the development of a condition may result in decreasing the severity of the symptoms of one of the conditions, or completely removing the symptoms. In this aspect of the invention, an "effective amount" is an amount effective to prevent the manifestation of symptoms of a disease, decrease the severity of the symptoms of a disease, and/or completely remove the symptoms. The successful treatment of a gram negative microbial infection in an animal is disclosed in Example 6, which demonstrates the protection against disease caused by *B. thailandensis* in a mouse model by administering a composition as described herein. These mouse models are a commonly accepted model for the study of human disease caused by these microbes.

This disclosure also provides methods for decreasing colonization by gram negative microbes, for instance blocking the attachment sites of gram negative microbe, including tissues of the skeletal system (for instance, bones, cartilage, tendons and ligaments), muscular system, (for instance, skeletal and smooth muscles), circulatory system (for instance, heart, blood vessels, capillaries and blood), nervous system (for instance, brain, spinal cord, and peripheral nerves), respiratory system (for instance, nose, trachea lungs, bronchi, bronchoceles, alveoli), digestive system (for instance, mouth, salivary glands esophagus, liver, stomach, large intestine, or small intestine), excretory system (for instance, kidneys, ureters, bladder and urethra), endocrine system (for instance, hypothalamus, pituitary, thyroid, pancreas and adrenal glands), reproductive system (for instance, ovaries, oviduct, uterus, vagina, mammary glands, testes, and seminal vesicles), lymphatic/immune systems (for instance, lymph, lymph nodes and vessels, mononuclear or white blood cells, such as macrophages, neutrophils, monocytes, eosinophils, basophils, and lymphocytes, including T cells and B cells), and specific cell lineages (for instance, precursor cells, epithelial cells, stem cells), and the like. Preferably, the gram negative microbe is a member of the family Burkholderiaceae, preferably, *Burkholderia* spp. such as, for example, *B. thailandensis, B. mallei, B. pseudomallei, B. cenocepacia*, or *B. multivorans*. Protein conservation suggests that the *Burkholderia* vaccines may also decrease colonization by other gram negative microbes such as *Achromobacter* spp., *Ralstonia* spp., *Pseudomonas* spp., *Bordetella* spp., and *Acinetobacter* spp.

Decreasing colonization in an animal may be performed prophylactically or, alternatively, therapeutically—in this context, initiated after the animal is colonized by the microbe. Treatment that is prophylactic—in this context, initiated before a subject is colonized by a microbe or while any colonization remains undetected—is referred to herein as treatment of a subject that is "at risk" of colonization by the microbe. Thus, typically, an animal "at risk" of colonization by a microbe is an animal present in an area where animals have been identified as colonized by the microbe and/or is likely to be exposed to the microbe even if the animal has not yet manifested any detectable indication of colonization by the microbe and regardless of whether the animal may harbor a subcolonization number of the microbe. Accordingly, administration of a composition can be performed before, during, or after the animal has first contact with the microbe. Treatment initiated after the animal's first contact with the microbe may result in decreasing the extent of colonization by the microbe, completely removing the microbe, and/or decreasing the likelihood that the animal becomes colonized by the microbe compared to an animal to which the composition is not administered. Thus, the method includes administering an effective amount of a composition as described herein to an animal colonized by, or at risk of being colonized by, a gram negative microbe. In this context, an "effective amount" is an amount sufficient to decrease colonization of the animal by the microbe, where decreasing colonization refers to one or more of: decreasing the extent of colonization by the microbe, completely removing the microbe, and/or decreasing the likelihood that the animal becomes colonized by the microbe compared to an animal to which the composition is not administered. Methods for evaluating the colonization of an animal by a microbe are routine and known in the art. For instance, colonization of an animal's intestinal tract by a microbe can be determined by measuring the presence of the microbe in the animal's feces. It is expected that decreasing the colonization of an animal by a microbe will reduce transmission of the microbe to humans.

A composition as described herein can be used to provide for active or passive immunization against bacterial infection. Generally, the composition can be administered to an animal to provide active immunization. However, the composition also can be used to induce production of immune products, such as antibody—e.g., a polyclonal antibody preparation or a monoclonal antibody—that can be collected from the producing animal and administered to another animal to provide passive immunity. Immune components such as, for example, antibody can be collected from serum, plasma, blood, colostrum, etc. to prepare compositions (preferably containing the collected antibody) for passive immunization therapies. Antibody compositions including monoclonal antibodies and/or anti-idiotypes can also be prepared using known methods. Chimeric antibodies include human-derived constant regions of both heavy and light chains and murine-derived variable regions that are antigen-specific (Morrison et al., 1984, *Proc. Natl. Acad. Sci. USA* 81(21):6851-6855; LoBuglio et al., 1989, *Proc. Natl. Acad. Sci. USA* 86(11):4220-4224; Boulianne et al., 1984, *Nature* 312(5995):643-646.). Humanized antibodies substitute the murine constant and framework (FR) (of the variable region) with the human counterparts (Jones et al., 1986, *Nature* 321(6069):522-525; Riechmann et al., 1988, *Nature* 332 (6162):323-327; Verhoeyen et al., 1988, *Science* 239(4847): 1534-1536; Queen et al., 1989, *Proc. Natl. Acad. Sci. USA* 86(24):10029-10033; Daugherty et al., 1991, *Nucleic Acids Res.* 19(9): 2471-2476.). Alternatively, certain mouse strains can be used that have been genetically engineered to produce antibodies that are almost completely of human origin; following immunization the B cells of these mice are harvested and immortalized for the production of human monoclonal antibodies (Bruggeman et al. 1997, *Curr. Opin. Biotechnol.* 8(4):455-458; Lonberg et al., 1995, *Int. Rev. Immunol.* 13(1):65-93; Lonberg et al., 1994, *Nature* 368: 856-859; Taylor et al., 1992, *Nucleic Acids Res.* 20:6287-6295.).

Passive antibody compositions and fragments thereof, e.g., scFv, Fab, F(ab')$_2$ or Fv or other modified forms thereof, may be administered to a recipient in the form of serum, plasma, blood, colostrum, and the like. Antibody may, however, also be isolated from serum, plasma, blood, colostrum, and the like, using known methods for later use in a concentrated or reconstituted form such as, for instance, lavage solutions, impregnated dressings and/or topical agents and the like. Passive immunization preparations may be particularly advantageous for the treatment of acute systemic illness, or passive immunization of young animals that failed to receive adequate levels of passive immunity through maternal colostrum. Antibody useful for passive immunization also may be useful to conjugate to various drugs or antibiotics that could be directly targeted to bacteria expressing during a systemic or localized infection a polypeptide as described herein or a polypeptide having an epitope structurally related to an epitope present on a polypeptide as described herein.

Animal models, in particular mouse models, are available for experimentally evaluating the compositions as described herein. These mouse models are commonly accepted models for the study of human disease caused by members of the genus *Burkholderia*, and, in particular *B. thailandensis*, *B. mallei*, *B. pseudomallei*, *B. cenocepacia*, or *B. multivorans*. In those cases where a member of the genus *Burkholderia* causes disease in an animal, the natural host can be used to experimentally evaluate the compositions as described herein.

However, protection in a mouse model is not the only way to assess whether a composition can confer protection to an animal against infection by a *Burkholderia* spp. The adaptive immune response consists of two primary divisions: the humoral (antibody) response and the cellular (T cell) response. Following infection by a bacterial pathogen, dendritic cells at the infection site encounter microbial antigens and produce signaling molecules such as, for example, surface receptors and cytokines in response to conserved molecular patterns associated with the specific bacterium. These signals are shaped by the nature of the pathogen and ideally lead to the appropriate antibody and T cell responses that protect the host from disease. While some bacterial diseases are controlled primarily through antibody functions, others require T cell responses or both antibody and T cell responses for protection. The goal of vaccine biology is to identify the immune responses that provide protection and then design a vaccine to reproduce one or more of these responses in humans.

Antibodies can have many different functions in the conferring protection against infection such as, for example, complement fixation, opsonization, neutralization, and/or agglutination. Moreover, some subclasses of antibodies are better than others at specific functions; for example, for complement fixation the following hierarchy exists for human IgG subclasses: IgG3>IgG1>IgG2>IgG4.

Antibody immunological functions can be studied in a variety of ways. For instance, Western blots are used to identify antigen-specific binding based on size of separated proteins, while the standard enzyme-linked immunosorbent assay (ELISA) is used to produce quantitative information about antibody titers within serum. Antibody surface binding studies are used to determine whether antibody in serum are able to recognize antigens on the surface of intact bacteria, an important indicator of whether the antibodies have the potential to work in vivo. Thus, one skilled in the art recognizes that antibody binding assays such as a Western blot, ELISA (e.g., using human antisera), and/or surface binding correlate positively with the specifically-bound antigens providing immunological activity against infection by *Burkholderia* spp. However, one skilled in the art further recognizes that a lack of antibody binding in an assay such as, for example, a Western blot, ELISA, or surface binding assay does not mean that the assayed antigen fails to provide immunological activity against infection by *Burkholderia* spp.

For example, FIG. 7 and Table 8 provide data showing antibody titer (FIG. 7) and Western blot data for certain representative *Burkholderia* iron-regulated polypeptides.

Techniques such as opsonophagocytosis assays (OPA), in which antibody and complement-bound bacteria are combined with human or mouse phagocytes to determine levels of bacterial killing, are useful for studying antibody function. Positive OPA results correlate with vaccine-induced protection in a mouse model. (Stranger-Jones et al., 2006, *Proc. Nati. Acad. Sci.* 103(45):16942-16947). A similar oxidative burst assay can be used to assess the level of reactive oxygen species (ROS) by fresh human or mouse neutrophils following interaction with antibody and complement-bound bacteria.

In some cases, one can determine that a candidate polypeptide possesses cell-mediated immunological activity and, therefore, the candidate polypeptide may exhibit immunological activity in the absence of inducing the production of antibodies. (Spellberg et al., 2008, *Infect. Immun.* 76(10): 4575-4580). Cytotoxic or $CD8^+$ T cells primarily kill infected cells directly through various effector mechanisms, while helper $CD4^+$ T cells function to provide important signaling in the way of cytokines. These T cell classes can be further subdivided based on the cytokines they produce, and different subclasses are effective against different bacterial pathogens. T cells are often studied by assessing their phenotypes with flow cytometry, where antibodies are used to visualize the levels of specific surface markers that enable classification of the T cells as, for example, a recently activated $CD4^+$ T cell, a memory $CD8^+$ T cell, etc. In addition, cytokines and other products of T cells can be studied by isolating the T cells from lymphoid tissue and re-stimulating them with cognate antigen. Following antigen stimulation the T cells produce cytokines that may be visualized by, for example, intracellular cytokine staining coupled with flow cytometry, or collecting the cell supernatants and using Luminex bead technology to measure 15-25 cytokines simultaneously.

For example, Table 9 provides cytokine recall response of spleen cells from mice immunized with representative *Burkholderia* iron-regulated polypeptides.

Thus, in addition to mouse models, those of ordinary skill in the art recognize that immunological activity commensurate with the methods described herein may correlate with any one or more of the following: Western blot data showing that serum from animals exposed to a *Burkholderia* spp. contains antibody that specifically binds to a candidate polypeptide, cell surface binding assays demonstrating that antibody that specifically binds to a candidate polypeptide specifically binds to a *Burkholderia* spp., opsonophagocytosis data, and cytokine induction.

Another aspect of the present invention provides methods for detecting antibody that specifically binds polypeptides as described herein. These methods are useful in, for instance, detecting whether an animal has antibody that specifically binds polypeptides as described herein, and diagnosing whether an animal may have a condition caused by a microbe expressing polypeptides described herein, or expressing polypeptides that share epitopes with the polypeptides described herein. Such diagnostic systems may be in kit form. The methods include contacting an antibody with a preparation that includes a polypeptide as described herein to result in a mixture. The antibody may be present in a biological sample, for instance, blood, milk, or colostrum. The method further includes incubating the mixture under conditions to allow the antibody to specifically bind the polypeptide to form a polypeptide:antibody complex. As used herein, the term "polypeptide:antibody complex" refers to the complex that results when an antibody specifically binds to a polypeptide. The preparation that includes the polypeptides as described herein may also include reagents, for instance a buffer, that provide conditions appropriate for the formation of the polypeptide:antibody complex. The polypeptide:antibody complex is then detected. The detection of antibodies is known in the art and can include, for instance, immunofluorescence or peroxidase. The methods for detecting the presence of antibodies that specifically bind to polypeptides as described herein can be used in various formats that have been used to detect antibody, including radioimmunoassay and enzyme-linked immunosorbent assay.

In another aspect, this disclosure provides a kit for detecting antibody that specifically binds polypeptides as described herein. The antibody detected may be obtained from an animal suspected to have an infection caused by a gram negative microbe, more preferably, a member of the family Burkholderiaceae, preferably, *Burkholderia* spp. such as, for example, *B. thailandensis, B. mallei, B. pseudomallei, B. cenocepacia*, or *B. multivorans*.

The kit can include at least one of the polypeptides as described herein (e.g., one, at least two, at least three, etc.), in a suitable packaging material in an amount sufficient for at least one assay. Optionally, other reagents such as buffers and solutions needed to practice the invention are also included. For instance, a kit may also include a reagent to permit detection of an antibody that specifically binds to a polypeptide as described herein, such as a detectably labeled secondary antibody designed to specifically bind to an antibody obtained from an animal. Instructions for use of the packaged polypeptides are also typically included. As used herein, the phrase "packaging material" refers to one or more physical structures used to house the contents of the kit. The packaging material is constructed by conventional methods, generally to provide a sterile, contaminant-free environment. The packaging material may have a label which indicates that the polypeptides can be used for detecting antibody that specifically binds polypeptides as described herein. In addition, the packaging material contains instructions indicating how the materials within the kit are employed to detect the antibody. As used herein, the term "package" refers to a container such as glass, plastic, paper, foil, and the like, capable of holding within fixed limits the polypeptides, and other reagents, for instance a secondary antibody. Thus, for example, a package can be a microtiter plate well to which microgram quantities of polypeptides have been affixed. A package can also contain a secondary antibody. "Instructions for use" typically include a tangible expression describing the reagent concentration or at least one assay method parameter, such as the relative amounts of reagent and sample to be admixed, maintenance time periods for reagent/sample admixtures, temperature, buffer conditions, and the like.

The present invention is illustrated by the following examples. It is to be understood that the particular examples,

EXAMPLES

Example 1—Preparation of *Burkholderia* Metal-Regulated Polypeptides

Compositions derived from *B. thailandensis* E264 included novel polypeptides expressed under iron restricted growth. Master seed stocks were prepared by inoculating a single colony of strain E264 into 100 mL Tryptic Soy Broth (TSB, Difco Laboratories, Detroit, Mich.) followed by incubation in a shaking incubator at 37° C. and 400 rpm overnight. The culture was expanded by a 1/100 dilution into fresh TSB and incubated as before until it reached the mid-log phase of growth. The bacteria were pelleted by centrifugation at 5000×g, 4° C., for 10 minutes. The supernatant was decanted, and an equal volume of PBS was added to resuspend the pellet. The bacteria were pelleted by centrifugation as before and the pellet was resuspended in TSB containing 15-50% glycerol at one-tenth of the original culture volume. Stocks were frozen in aliquots of 100-1000 µL and stored at −80° C. Working seed stocks were prepared using the same procedure but with the initial inoculum obtained from a frozen master stock vial.

The iron-regulated polypeptide (IRP) composition was prepared by inoculating *B. thailandensis* from a frozen stock into 10 mL tryptic soy broth (TSB) supplemented with 200 µM 2,2'-dipyridyl (DP) (Sigma-Aldrich, St. Louis, Mo.). Iron-replete cultures contained 300 µM $FeCl_3$. Cultures were incubated at 37° C. on a shaker at 400 rpm. After 16-24 hours incubation, 10 mL of culture was transferred into 90 mL prewarmed TSB supplemented with either 200 µM DP or 300 µM $FeCl_3$ and incubated at 37° C. on a shaker at 400 rpm. After 16-24 hours, 90 mL of culture was transferred into 900 mL prewarmed TSB supplemented with either 300 µM $FeCl_3$ or 400 µM DP and incubated at 37° C. on a shaker at 400 rpm. After 16-20 hours the cells were harvested by centrifugation at 10,000×g for 20 minutes at 4° C., resuspended in PBS and centrifuged to obtain the final cell pellet. The cell pellets were weighed and stored frozen at −80° C.

The frozen cell pellet was thawed at room temperature and resuspended by the addition of 25 mL Tris-EDTA buffer (15 mM Tris-HCl, 3 mM EDTA, pH 8.5) per gram of pellet. The cell suspension was distributed into sterile 50 mL conical tubes at a volume of 35 mL/tube. Tubes were placed in a −80° C. freezer for a minimum of 30 minutes after which they were removed and thawed at 25° C.-37° C. The cells were disrupted by sonication (Branson, Danbury, Conn.) for 90 seconds on ice. The disrupted cell suspension was transferred to a sterile 40 mL round bottom centrifuge tube and centrifuged at 39,800×g for 20 minutes at 4° C. The soluble membrane fraction in the supernatant was transferred to a sterile 40 mL round bottom centrifuge tube, and 3 mL of 30% sarcosine (N-lauroylsarcosine sodium salt, Sigma-Aldrich, St. Louis, Mo.) was added to each tube. Tubes were incubated for 16-24 hours at 4° C. with rocking. The detergent-insoluble membrane fraction was pelleted by centrifugation at 39,800×g for two hours at 4° C. followed by removal of the supernatant. Pellets were dried by inverting the tubes for a minimum of five minutes. The pellets were resuspended in 75 µl PBS (pH 7.2).

A sample of the pellet was evaluated by denaturing SDS-PAGE using 10% gels stained with Coomassie Blue and imaged using a LI-COR Odyssey infrared imaging system (LI-COR Biosciences, Lincoln, Nebr.)(FIG. 1). The banding profile indicated that expression of polypeptides in the 64 kDa to 98 kDa region was increased when *B. thailandensis* was grown under iron restriction (lane 3, DP) relative to growth in the presence of iron (lane 2, Fe). This is similar to what has been observed for other Gram negative bacteria grown under iron restriction and corresponds to receptors that are involved in iron acquisition.

Example 2—Two-Dimensional (2D) Gel Analysis of Iron-Regulated Polypeptides

Two-dimensional PAGE separation of membrane extracts from *B. thailandensis* grown under either iron-rich or iron-depleted conditions was performed using an acidic polyacrylamide system with cationic detergent benzyldimethyl-n-hexadecylammonium chloride (16-BAC) for the first dimension and sodium dodecyl sulfate (SDS) for the second dimension (Hartinger et al., 1996, *Anal Biochem* 240:126-133). A 50 µg sample of membrane extract was solubized in 7.5 M urea, 10% 16-BAC (w/v), 75 mM DTT, and 0.05% pyronin Y, and electrophoresis was conducted using an 8.7% acrylamide gel with a 50 mM phosphoric acid running buffer. Electrophoretic separation in the 16-BAC phase was carried out at a current of 15 mA, from anode to cathode, at 4° C. overnight until the dye front migrated out of the gel. The gel was stained with 8250 Coomassie Blue. Each lane was excised and equilibrated through four changes of 0.1 M Tris, pH 6.8, with further equilibration in reducing buffer (75 mM Tris, 576 mM glycine, 0.3% SDS, 5% β-mercaptoethanol) for five minutes. Gel strips were overlaid onto the second dimension gel and fixed into place with 0.1% agarose. SDS-PAGE (5-16% gradient) separation was performed using a PROTEAN plus dodeca cell (Bio-Rad Laboratories, Inc., Hercules, Calif.) at 25 mA/gel until the dye front migrated out of the gel.

Figure 2:
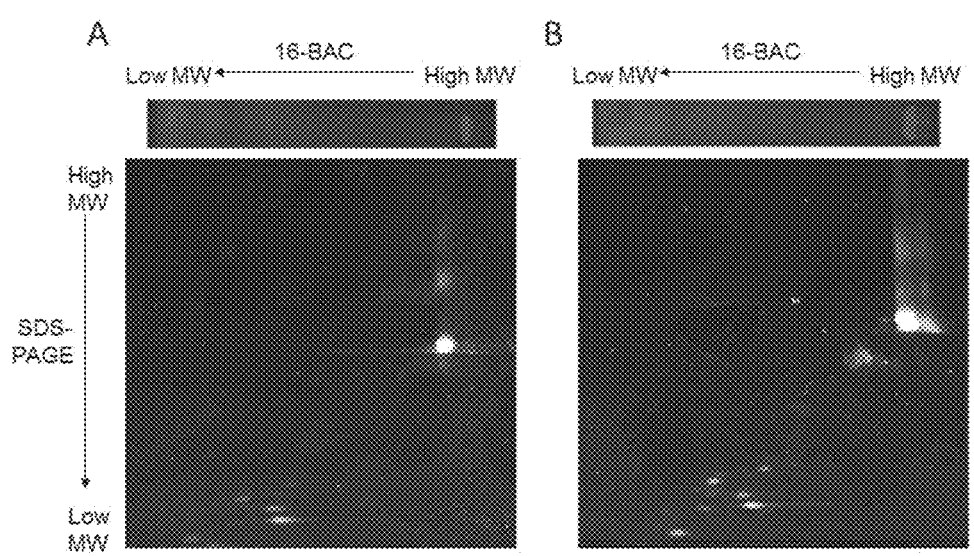
FIG. 2. Two-dimensional gel electrophoresis analysis of extracts from *B. thailandensis* grown in either (A) iron-rich or (B) iron-depleted medium.

Separation in the first and second dimensions is dependent on molecular weight, hence, larger polypeptides appear in the upper right portion of the second dimension gel, and polypeptides of decreasing molecular weight appear on a diagonal toward the lower left portion of the gel (FIG. 2). The increased intensity of staining associated with iron restriction in FIG. 2B compared with extracts from cells grown in the presence of iron in FIG. 2A indicates that the expression of these polypeptides is upregulated under iron restriction.

Example 3—Identification of Iron-Regulated Polypeptides in the Extract

Extracts of *B. thailandensis* grown under iron depleted conditions were subjected to 2D gel electrophoresis as described in Example 2. Regions of the gel that stained positive for polypeptides were excised from the second dimension gel and analyzed by matrix-assisted laser desorption/ionization mass spectrometry (MALDI-MS) according to the following procedure (Wilm et al., 1996, *Nature* 379:466-469). The excised gel spot was cut into smaller pieces and washed twice with water for 10 minutes each. All wash volumes were approximately equal to twice the volume of the gel pieces. The gel pieces were washed with a 1:1 mix of acetonitrile and 100 mM ammonium bicarbonate, pH 7.4, for 15-30 minutes. The wash was repeated once or twice as needed to remove the stain. The last wash was replaced with sufficient 100% acetonitrile (ACN) to cover the gel pieces until they turned opaque and sticky, whereupon they were removed and dried in a SAVANT SPEEDVAC (Thermo Fisher Scientific Inc., Waltham, Mass.) at 30° C. for 30 minutes. The dried gel pieces were placed into 25-30 µl of 50 mM ammonium bicarbonate containing trypsin at 110 ng/µl and digested for 16-18 hours at 37° C. Following digestion, the mixture was separated by centrifugation, the supernatant was removed, and a volume of 25-30 µl 0.1% trifluoroacetic acid (TFA) was added to extract the peptides. The samples were sonicated intermittently for 30 minutes, and supernatants containing the peptides were transferred into new tubes. The gel extraction was repeated using a solution of 0.1% TFA/30% ACN followed by 0.1% TFA/70% ACN. The pooled supernatants were concentrated in a SPEEDVAC to a final volume of 30-70 µl.

MALDI-MS analysis was performed using nano high-pressure liquid chromatography electrospray tandem mass spectrometry (nanoLC-ESI-MS/MS) methods with LTQ ORBITRAPS (Thermo Fisher Scientific Inc., Waltham, Mass.) coupled with NanoLC-2D pumps (Eksigent Technologies, LLC, AB SCIEX, Framingham, Mass.) for data acquisition and Scaffold analysis tool (Proteome Software, Portland, Oreg.) to compile the outputs from multiple search algorithms.

A polypeptide was considered to be present if at least two unique peptides for that polypeptide were identified in an excised gel spot. Fifteen polypeptides of interest were identified in the iron restricted extract (Table 2). Eight of the fifteen were detected only in the iron restricted extract and not in extracts from *B. thailandensis* grown in the presence of iron. These eight polypeptides are reflected in SEQ ID NO:1, SEQ ID NO:2, SEQ ID NO:3, SEQ ID NO:7, SEQ ID NO:16, SEQ ID NO:21, SEQ ID NO:22, and SEQ ID NO:25.

TABLE 2

Polypeptides identified in outer membrane preparations of *B. thailandensis* grown under iron restricted conditions.

| SEQ ID # | Polypeptide | GI Number | Molecular Weight (kDa)[a] |
|---|---|---|---|
| 1 | TonB-dependent siderophore receptor | 83718630 | 81 |
| 2 | RND efflux system outer membrane lipoprotein | 83717404 | 55 |
| 3 | Outer membrane ferric siderophore receptor | 83716122 | 84 |
| 7 | TonB-dependent copper receptor | 83717103 | 81 |
| 9 | OmpA family protein | 83720098 | 27 |
| 11 | OmpA family protein | 83720431 | 24 |
| 12 | Outer membrane porin | 83719322 | 40 |
| 13 | Outer membrane porin | 83716488 | 44 |
| 14 | Outer membrane porin | 83718334 | 39 |
| 15 | Outer membrane porin | 83716254 | 55 |
| 16 | RND efflux system outer membrane lipoprotein | 83720933 | 58 |
| 17 | RND efflux system outer membrane lipoprotein | 83718989 | 55 |
| 21 | Outer membrane porin | 83718226 | 42 |
| 22 | RND efflux system outer membrane lipoprotein | 83719074 | 56 |
| 25 | RND efflux transporter MFP subunit | 83720836 | 43 |

[a]Molecular weight (predicted).

Example 4—Differential Expression of Iron-Regulated Polypeptides in the Extract The isobaric tags for relative and absolute quantification (iTRAQ) method was used to evaluate changes in expression of outer membrane proteins associated with growth of *B. thailandensis* in iron-depleted compared with iron-replete medium. Cultures were grown as described in Example 1, and 40 µg of outer membrane extract was evaluated. The primary amines of peptides and polypeptides were labeled with isobaric agents using ITRAQ-8plex reagents (Applied Biosystems, Life Technologies Corp., Carlsbad, Calif.) according to the manufacturer's instructions. Cation exchange chromatography was applied using an MCX column (Waters Corp., Milford, Mass.), and the peptides were separated using an UltiMate 3000 nano LC system (Dionex Corp., Sunnyvale, Calif.) coupled to ESI mode using a QSTAR XL mass spectrometer (Applied Biosystems, Life Technologies Corp., Carlsbad, Calif.).

The results are shown as the fold increase for a given protein in the iron restricted extract relative to the iron-replete extract (Table 3). A polypeptide was considered to be iron-regulated if it displayed a fold increase greater than 1 in at least two trials. Polypeptides identified as iron-regulated using iTRAQ analysis include those reflected in SEQ ID NO:1, SEQ ID NO:2, SEQ ID NO:3, SEQ ID NO:4, SEQ ID NO:6, SEQ ID NO:9, SEQ ID NO:10, SEQ ID NO:11, SEQ ID NO:13, and SEQ ID NO:16.

TABLE 3

Detection and differential upregulation of *B. thailandensis* outer membrane polypeptides during iron-restricted growth.

| SEQ ID NO | GI Number | Molecular Weight (kDa)[a] | Fold increase by iTRAQ[b] (Trial No.) (1) | (2) | (3) | (4) |
|---|---|---|---|---|---|---|
| 1 | 83718630 | 81 | 4.1 | 4.55 | 1.1 | 2.0 |
| 2 | 83717404 | 55 | 6.6 | 16.71 | 2.4 | 3.8 |
| 3 | 83716122 | 84 | 1.4 | 1.81 | 1.01 | 1.3 |
| 4 | 83717803 | 83 | ND | ND | 1.5 | 1.8 |
| 5 | 83716062 | 81 | ND | ND | 0.99 | 0.95 |
| 6 | 83720594 | 88 | ND | ND | 1.2 | 1.2 |
| 7 | 83717103 | 81 | ND | 0.64 | 0.37 | 0.52 |
| 9 | 83720098 | 27 | 1.6 | 1.74 | 0.39 | 1.6 |
| 10 | 83719210 | 19 | 1.7 | 1.72 | 0.42 | 1.1 |
| 11 | 83720431 | 24 | 1.4 | 1.55 | 0.47 | 0.68 |
| 12 | 83719322 | 40 | 0.99 | 0.99 | 0.24 | 0.43 |
| 13 | 83716488 | 44 | 0.93 | 1.16 | 1.0 | 1.3 |
| 14 | 83718334 | 39 | 0.81 | 1.35 | 0.31 | 0.67 |
| 15 | 83716254 | 55 | 0.58 | 0.8 | 0.53 | 0.39 |
| 16 | 83720933 | 58 | 1.2 | 1.29 | 0.52 | 0.89 |
| 17 | 83718989 | 55 | 0.73 | 0.72 | ND | ND |
| 18 | 83717287 | 19 | 0.18 | 0.17 | 0.17 | 0.14 |
| 20 | 83718178 | 36 | 2.7 | ND | ND | ND |
| 21 | 83718226 | 42 | ND | ND | 0.45 | 0.46 |
| 22 | 83719074 | 56 | ND | ND | 1.1 | 0.75 |

[a]Molecular weight (predicted).

[b]Fold upregulation of polypeptides in extract vaccine from *B. thailandensis* E264 grown under iron-restricted compared with iron-replete conditions. A value of "ND" indicates that no peptides were detected.

Example 5—Identification of Additional Polypeptides Involved in Iron Uptake and Utilization, and Determination of Iron Regulation A bioinformatics approach was undertaken to identify additional polypeptides that might be involved in iron uptake or utilization in *B. thailandensis* E264. Polypeptides of interest that had not already been identified as described in Examples 3 and 4 were downselected further to those shown in Table 4 based on structural similarity to known iron receptor proteins, localization in the bacterial outer membrane (computationally predicted by PSORTb V3.0), and additional information implicating them as iron receptors through comparison with *B. pseudomallei* orthologs. In addition, the polypeptide reflected in SEQ ID NO:19, which is involved in the acquisition and release of iron from intracellular storage by bacterioferritin, was also identified as a potential vaccine target.

TABLE 4

Additional *B. thailandensis* E264 polypeptides involved in iron uptake and utilization

| SEQ ID NO: | Polypeptide | GI Number | Molecular Weight (kDa)[a] |
|---|---|---|---|
| 8 | TonB-dependent siderophore receptor | 83717123 | 81 |
| 19 | Bacterioferritin-associated ferredoxin- Bfd | 83718020 | 8.5 |
| 23 | TonB-dependent receptor | 83718695 | 85 |
| 24 | TonB-dependent receptor | 83717289 | 78 |

[a]Molecular weight (predicted).

The final determination of metal regulation for candidate proteins was based on mass spectroscopy, iTRAQ analysis, and bioinformatics described in Examples 3, 4, and 5, respectively. Each of the 25 polypeptides was determined to be either iron-regulated, non-iron regulated, or had iron regulation that was uncertain (Table 5). This determination was made using the following, step-wise inclusion criteria. First, any protein that was detected in mass spectroscopy of iron-restricted but not iron replete extracts was considered to be iron-regulated. Second, any protein that demonstrated a fold increase in expression of greater than 1 in iTRAQ analysis was considered to be iron-regulated. This resulted in a total of 14 polypeptides being classified as iron-regulated. Of the remaining proteins, four were considered to be non-metal-regulated if they were detected in at least two iTRAQ trials but did not demonstrate a fold increase greater than 1. Seven polypeptides could not be definitively categorized as either iron-regulated or non-iron regulated, and these were classified as polypeptides whose iron regulation was uncertain.

TABLE 5

Summary of iron regulation for 25 candidate proteins

| SEQ ID NO: | Molecular Weight (kDa)[a] | Iron regulation[b] |
|---|---|---|
| 1 | 81 | IR |
| 2 | 55 | IR |
| 3 | 84 | IR |
| 4 | 83 | IR |
| 5 | 81 | U |
| 6 | 88 | IR |
| 7 | 81 | IR |
| 8 | 81 | U |
| 9 | 27 | IR |
| 10 | 19 | IR |
| 11 | 24 | IR |
| 12 | 40 | NIR |
| 13 | 44 | IR |
| 14 | 39 | NIR |
| 15 | 55 | NIR |
| 16 | 58 | IR |
| 17 | 55 | U |
| 18 | 19 | NIR |
| 19 | 8.5 | U |
| 20 | 36 | U |
| 21 | 42 | IR |
| 22 | 56 | IR |
| 23 | 85 | U |
| 24 | 78 | U |
| 25 | 43 | IR |

[a]Molecular weight (predicted).
[b]IR, iron regulated; NIR, non-iron regulated; U, iron regulation is uncertain Example 6—Animal Efficacy Studies Vaccine efficacy studies were conducted in BALB/c and A/J mice using 15 mice per group. Vaccines were formulated to deliver doses of 50 ng, 100 ng, and 300 ng of extract vaccine containing 10 ng/dose of CpG and emulsified in 50% incomplete Freund's adjuvant (IFA). The placebo group consisted of IFA/CpG alone. Mice were immunized subcutaneously in a volume of 100 µl at Day 0 with a booster at Day 28.

On Day 42, mice were challenged intratracheally with a previously determined LD80 of *B. thailandensis* E264, and survival was monitored for 14 days. The challenge dose of *B. thailandensis* E264 was prepared as follows. A loop of bacteria was taken from a frozen glycerol stock, placed into 10 mL Luria Bertani (LB) broth, and incubated at 37° C. overnight. The 10 mL culture was inoculated into 100 ml of LB, incubated at 37° C. and monitored for growth by optical density at a wavelength of 600 nm ($OD_{600}$). When the culture reached an $OD_{600}$ of 1.9 (approximately $1 \times 10^9$ cfu/ml), the suspension was serially diluted with PBS to the predetermined challenge dose. All suspensions and dilutions were plated on LB agar to verify the actual concentration of bacteria administered.

Aerosolized challenge of mice was performed by intratracheal instillation according to an established protocol. In brief, mice were lightly anesthetized with a mixture of ketamine and xylazine (80 mg/kg ketamine and 20 mg/kg xylazine). The animal was manually restrained in an upright position and a padded forceps was used to gently open the mouth and hold the tongue down to the lower jaw to prevent swallowing. A second investigator then carefully administered 30 µl fluid to the back of the mouth using a sterile pipette tip and a p100 PIPETMAN (Gilson, Inc., Middleton, Wis.). This was followed by placing a gloved finger over the mouse nostrils to prevent obligate nasal breathing. The combination of holding the tongue to prevent swallowing and closing off the nostrils to prevent nasal breathing causes the mouse to inhale through the mouth and aspirate the instilled fluid. An immediate cough by the mouse, which can be detected both audibly and visibly, was used to verify that the procedure was performed correctly.

Figure 3:
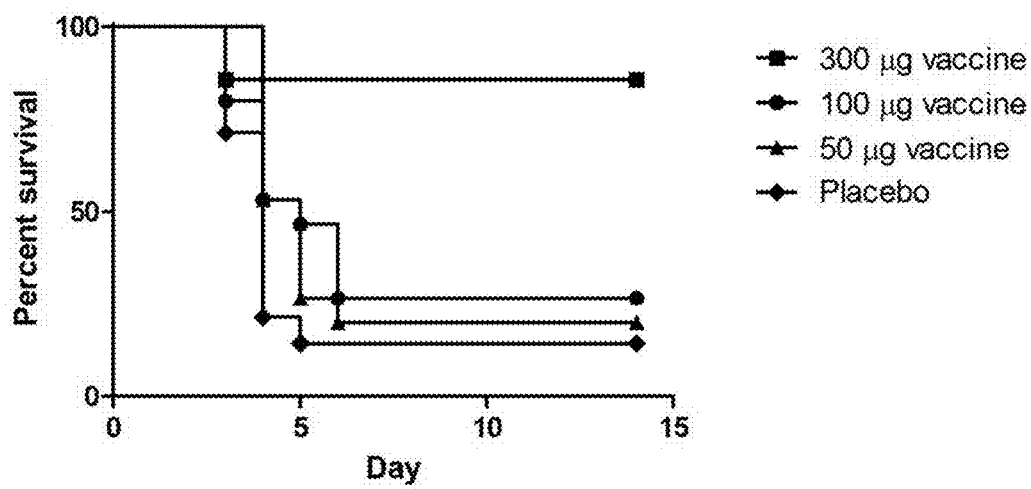
FIG. 3. Data from a vaccine trial in A/J mice. Kaplan-Meier survival curve of A/J mice immunized twice with varying doses of vaccine (50 ng/dose, 100 µg/dose, or 300 ng/dose) or a placebo (adjuvant only) and challenged intratracheally with *B. thailandensis*.
Figure 4:
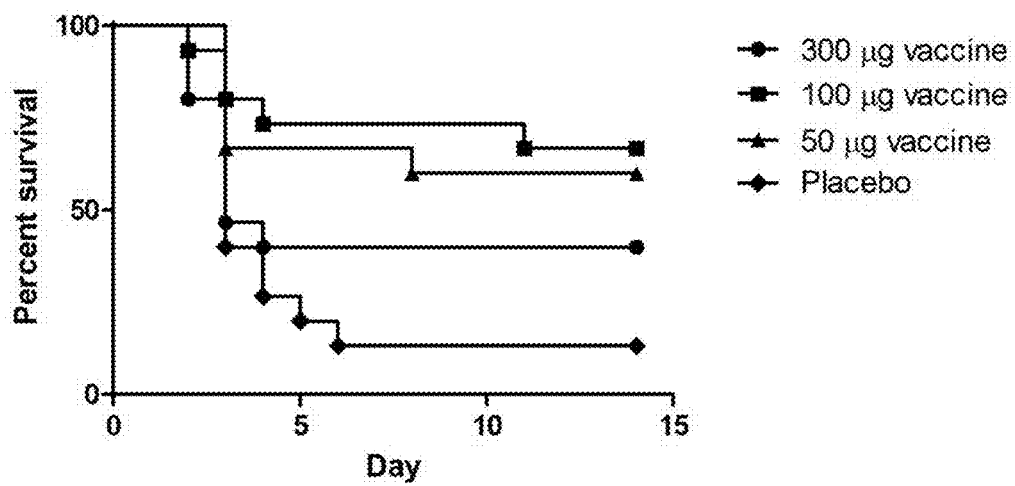
FIG. 4. Data from a vaccine trial in BALB/c mice. Kaplan-Meier survival curve of BALB/c mice immunized twice with varying doses of vaccine (50 ng/dose, 100 ng/dose, or 300 ng/dose) or a placebo (adjuvant only) and challenged intratracheally with *B. thailandensis*.

The results are shown in FIG. 3 and FIG. 4. In A/J mice, the 300 µg dose of vaccine resulted in 86% survival compared with 14% in the placebo. Lower doses of vaccine were not as protective. The increase in survival of vaccinated A/J mice, which are deficient in complement component C5, indicates that the vaccine is efficacious in animals that are predisposed to infection. Thus, the vaccine may also be effective in immunocompromised patients such as those with cystic fibrosis or diabetes. Protection in BALB/c mice was more robust, with increased survival demonstrated at all three doses of the vaccine. Compared with 13% survival in the placebo, vaccinates showed 67% and 60% survival at the 100 µg and the 50 µg doses, respectively, and 40% survival at the 300 µg dose.

Example 7—Conservation of Iron-Regulated Polypeptides

Because iron-regulated polypeptides tend to be evolutionarily conserved, the *B. thailandensis* extract vaccine would be expected to protect against infection by two of the most highly virulent species of *Burkholderia*, namely, *B. pseudomallei* and *B. mallei*. It may also protect against other *Burkholderia* such as those in the *B. cepacia* complex (BCC) that cause opportunistic infections in people with cystic fibrosis and chronic granulomatous disease. In this regard, *B. cenocepacia* (formerly BCC genomovar III) and *B. multivorans* (formerly BCC genomovar II) are two of the most common isolates from cystic fibrosis patients and are associated with increases in morbidity and mortality.

In the Example 6 lethal challenge studies, *B. thailandensis* was selected as a seed strain for the extract vaccine due to safety considerations associated with employing a BSL3 agent in manufacturing. However, recombinant polypeptide vaccines represent an alternative approach that is not subject to this limitation. Thus, a recombinant *Burkholderia* vaccine could employ polypeptides cloned directly from *B. pseudomallei*, which is highly lethal and difficult to treat, recognized as a potential bioweapon, endemic in certain parts of Asia and Australia, and considered to be an emerging infectious agent in other parts of the world. To address the possibility of whether a broad spectrum vaccine could be created using extract or recombinants, a bioinformatics approach was undertaken to compare the percent identity of the polypeptides identified in Examples 3, 4, and 5 across a variety of *Burkholderia* species and strains. Targeted vaccine polypeptides were compared by standard protein BLAST (blastp, NCBI) using a database of non-redundant polypeptide sequences and default parameters. To provide information on both the *B. thailandensis* extract vaccine and the *B. pseudomallei* recombinant vaccine, the analysis was performed using *B. thailandensis* E264 or *B. pseudomallei* K96243 polypeptides as the query against a subset of the sequenced *Burkholderia* strains available through GenBank. This panel of targeted strains was selected to achieve diversity based on geographic variability and differences in clinical disease and/or outcomes. Strains of particular interest to the Defense Threat Reduction Agency, as indicated in Broad Agency Announcements, were also included. Information on the selected strains and their sources is shown in Table 6.

TABLE 6

Names and sources of strains used to compare sequence conservation of iron-regulated polypeptides

| Species | Strain | Source |
|---|---|---|
| *B. pseudomallei* | K96243 | Human, septicemia, fatal, Thailand, 1996 |
| | Pakistan9 | Human melioidosis, Pakistan, 1988 |
| | 1106a | Human isolate from liver abscess aspirate, survived but relapsed, Thailand, 1993 |
| | 1710a | Human blood culture isolate (bacteriemia with lung and soft tissue involvement), Thailand, 1996 |
| | 1710b | Human blood culture isolate (second isolation from relapse of same patient as 1710a), fatal, Thailand, 1999 |
| | 576 | Human melioidosis, atypical LPS and highly virulent in mice, Thailand, 1989 |
| | Pasteur 52237 | Human melioidosis, Vietnam or Thailand (from the Finkelstein collection) |
| | S13 | Environmental strain, mucoid, Singapore |
| | 406e | Human, lethal disseminated disease (bacteremia, lung, skin, and renal involvement), Thailand, 1988 |
| | MSHR668 | Human blood culture isolate, severe melioidosis encephalomyelitis, Australia, 1995 |
| | MSHR305 | Human brain, encephalomyelitis, fatal, Australia, 1994 |
| | 1026b | Human blood culture isolate, disseminated disease (bacteremia with skin, soft tissue, joint, and spleen involvement), Thailand, 1993 |

TABLE 6-continued

Names and sources of strains used to compare sequence conservation of iron-regulated polypeptides

| Species | Strain | Source |
|---|---|---|
| *B. mallei* | NCTC10229 | Hungary, 1961 |
| | ATCC23344 | Human glanders/melioidosis, fatal, Burma, 1944 |
| | NCTC10247 | Unknown passage history, avirulent in hamsters, Turkey, 1960 |
| | PRL-20 | Horse blood isolate, Pakistan (Lahore Polo Club outbreak), 2005 |
| | ATCC10399 | Horse lung isolate, China, 1942 |
| | GB8 horse 4 | Horse-passaged derivative of ATCC23344 |
| | SAVP1 | Natural infection, overseas isolate, severity likely mild |
| *B. thailandensis* | E264 | Environmental isolate, Thailand |
| | MSMB43 | Environmental isolate (water), Australia |
| | MSMB121 | Environmental isolate, Australia |
| *B. cenocepacia* | AU1054 | Human blood isolate, cystic fibrosis patient, epidemic isolate |
| | HI2424 | Onion field soil isolate |
| | J2315 | Human sputum isolate, cystic fibrosis patient, epidemic isolate, ET-12 lineage, United Kingdom-most studied |
| | MC0-3 | Corn field soil isolate, United States, 2004 |
| | PC184 | Human, cystic fibrosis patient, epidemic isolate, United States |
| | H111 | Human, cystic fibrosis patient, Germany, 1993 |
| *B. multivorans* | ATCC17616 | Environmental soil isolate, United States |
| | ATCC BAA-247 | Human sputum, cystic fibrosis patient, Belgium |
| | CF2 | Human sputum, United States |
| | CGD1 | Human sputum, chronic granulomatous disease patient, United States |
| | CGD2 | Human blood, chronic granulomatous disease patient, United States |

Amino acid sequence comparisons for the polypeptides reflected in SEQ ID NO:1 through SEQ ID NO:25 are shown in FIG. 5A and FIG. 5B using *B. pseudomallei* K96243 or *B. thailandensis* E264 as the query, respectively. All strains of *B. pseudomallei* and *B. mallei* showed at least 98% identity with the *B. pseudomallei* K96243 vaccine strain. *Burkholderia cenocepacia* and *B. multivorans* were more divergent but still exhibited substantial homology that in some cases reached 90% or higher. A similar trend was noted using *B. thailandensis* E264 as the query. The high level of sequence identity with *B. pseudomallei* and *B. mallei* reflects their close phylogenetic relationship and suggests that *B. thailandensis* polypeptides would be capable of generating cross-reactive immune responses to these species. This may also be true for *B. cenocepacia* and *B. multivorans*, if there is sufficient conservation in regions of the polypeptides that are immunogenic.

To further evaluate the conservation of the iron-regulated polypeptides across multiple species, a cross-species alignment was performed for the polypeptides reflected in SEQ ID NO:1, SEQ ID NO:2, and SEQ ID NO:9 using Clustal Omega (v1.2.0, European Molecular Biology Laboratory-European Bioinformatics Institute) and one strain from each of the five species. These three polypeptides were selected because they are representative of three different types of iron-regulated polypeptides, namely, a siderophore receptor (SEQ ID NO:1), an RND efflux system polypeptide (SEQ ID NO:2), and an OmpA family outer membrane polypeptide (SEQ ID NO:9), and they showed varying levels of identity across species. The strains used for comparison were *B. thailandensis* E264, *B. pseudomallei* K96243, *B. mallei* NCTC10229, *B. cenocepacia* AU1054, and *B. multivorans* ATCC17616.

The alignments indicate that certain regions of these three polypeptides are highly conserved across strains selected from all five Burkholderia species of interest (FIG. 6). The polypeptide reflected in SEQ ID NO:1 shows greater variability at the amino terminus, which is where the signal sequence, generally subject to cleavage, is located. This was also apparent though less dramatic for the polypeptide reflected in SEQ ID NO:2. The polypeptide reflected in SEQ ID NO:9 was highly conserved, although *B. thailandensis* E264 was somewhat unique in that it had additional amino acids at the amino terminus that were not present in any of the other species. Further examination of *B. thailandensis* strains revealed that MSMB43 also had additional amino acids at the amino terminus, though fewer than E264, whereas MSMB121 did not (not shown). Nonetheless, the remainder of this polypeptide was highly conserved.

Example 6—Immunogenicity of IRPs

Vaccine Preparation

A comparative immunogenicity study was performed to evaluate the humoral and cellular immune responses elicited by the *B. thailandensis* IRP (iron-regulated polypeptide) extract vaccine, a purified subunit of the IRP extract vaccine, and a mixture of eight recombinant polypeptides cloned from *B. pseudomallei* K96243 (eight recombinant *Burkholderia* IRPs, rBIRP8, Table 7).

TABLE 7

Recombinant *B. pseudomallei* K96243 polypeptides

| SEQ ID NO: | Polypeptide | GI Number | Molecular Weight (kDa)[a] |
|---|---|---|---|
| 51 | Iron uptake receptor | 53719389 | 83 |
| 52 | Multidrug efflux system protein | 53721329 | 55 |
| 53 | Iron transport receptor protein | 53722229 | 82 |
| 54 | Exported heme receptor protein | 53721278 | 82 |
| 55 | Fe(III)-pyochelin receptor | 53721627 | 82 |
| 56 | Ton B-dependent outer membrane receptor protein | 53720334 | 81 |
| 57 | Outer membrane copper receptor | 53722763 | 80 |
| 58 | TonB-dependent receptor family protein | 53722050 | 88 |

[a]Molecular weight (predicted).

The extract vaccine used in these studies was prepared as described in Example 1, and the purified subunit vaccine was prepared with the following modifications. After breaking the cells, the soluble fraction was diluted 1:1 with 0.1 M sodium carbonate and mixed at 4° C. for one hour before continuing with centrifugation of the membrane fraction and sarcosine extraction. The insoluble extract product was subjected to a hot phenol extraction (Westphal et al., 1965, *Methods in Carbohydrate Chemistry* 5:83-91). In brief, the insoluble extract was resuspended in water and heated to 70° C. An equal volume of phenol was added, the temperature was re-equilibrated to 70° C., and the mixture was maintained at this temperature for 30 minutes. The phases were separated at room temperature using a glass separatory funnel. The phenol fraction and interface were combined and precipitated by the addition of methanol at a 3:1 v:v ratio. The polypeptides were recovered by centrifugation for one hour at 30,000×g and the pellet was washed with methanol. Methanol was removed through two sequential washes with a 50 mM Tris/1 mM EDTA buffer, and the final pellet was recovered by centrifugation for one hour at 45,000×g. The pellet was resuspended in a buffer containing 50 mM Tris, 1 mM EDTA, 7 M urea, 2 M thiourea, and 1% zwittergent by adding a volume of 1 ml per mg of pellet. The pellet was further solubilized by sonication at 60° C.-65° C. for 10 minute cycles interspersed with a 10 minute rest, followed by overnight incubation at room temperature on a rocking platform. The resulting product had an endotoxin level of <100 EU/mg as determined by a kinetic-turbidimetric Limulus amoebocyte lysate (LAL) assay (Charles River Laboratories, Wilmington, Mass.).

Eight IRP coding regions were cloned from *B. pseudomallei* K96243 DNA and expressed in *E. coli* (Table 7). The signal peptide sequence was predicted using SignalP (Center for Biological Sequence Analysis, Technical University of Denmark, Lyngby, Denmark) and, in some cases, PrediSi (Institute for Microbiology, Technical University of Braunschweig, Braunschweig, Germany) or Phobius (Stockholm Bioinformatics Centre, Stockholm University, Stockholm, Sweden). Gene-specific primers were designed to express the polypeptide without the signal sequence. PCR was performed using DNA Herculase II (Agilent Technologies, Santa Clara, Calif.), and the PCR products were ligated into the pQE30Xa expression vector (Qiagen, Valencia, Calif.), which adds a 6× Histidine tag to the N-terminus Ligation reactions were used to transform *E. coli* XL-1 blue. Clones were selected and verified by DNA sequencing (ACGT, Inc., Wheeling, Ill.). The recombinant *B. pseudomallei* iron-regulated polypeptides (rBIRPs) were expressed and purified using standard methods. In brief, frozen bacterial stocks (100 μl) were used to inoculate 20 ml of Luria-Bertani Broth containing 100 μg/ml of ampicillin, and the culture was grown at 37° C. in a shaking incubator at 250 rpm. After 16 hours, the culture was diluted added to 1 L of Luria-Bertani Broth containing 100 μg/ml of ampicillin, grown to an optical density (600 nm) of 0.6, and induced by the addition of 1 mM IPTG to a final concentration of 1 mM. Cultures were incubated for an additional 4-20 hours, depending on the optimum time for expression as previously determined for each clone. Bacterial cell pellets were harvested by centrifugation at 4,000 rcf for 20 minutes at 4° C., washed in PBS, and resuspended in 20 mM Tris buffer containing 100 μg/ml lysozyme. The cells were disrupted by sonication at 50% duty cycle and output (Branson Sonifier, Danbury, Conn.) for eight minutes on ice. The lysate was subjected to centrifugation for 10 minutes at 40,000×g at 4° C. to remove insoluble material. The soluble supernatants were processed by immobilized metal affinity chromatography (HisTrap FF 5 ml, GE Healthcare) to purify the histidine-tagged recombinant polypeptide, followed by anion exchange chromatography to increase the purity and remove endotoxin. Polypeptide concentration was determined using the BCA method (Thermo Scientific, Rockford, Ill.) and polypeptide purity was measured by SDS-PAGE and densitometry.

Immunization of Mice

BALB/c mice were vaccinated with 100 μg *B. thailandensis* E264 extract vaccine, 100 μg *B. thailandensis* E264 purified subunit vaccine (Example 6), or a mixture of eight rBIRPs (rBIRP8, polypeptides of SEQ ID NO:1-SEQ ID NO:8 at 10 μg each). Vaccines were formulated with 10 μg CpG per dose and emulsified in 50% IFA. The placebo group consisted of IFA/CpG alone. Each group contained a total of 5 mice. Vaccines were administered subcutaneously in a volume of 100 μl at Day 0 with a booster at Day 28. Mice were bled on Day −1 (one day before the initial vaccination) and Day 27 with a terminal bleed performed on Day 56. Blood was processed to obtain serum, which was stored at −80° C. Equal volumes of individual serum samples were pooled and evaluated for antibody production.

ELISA

IgG antibody titers to individual rBIRPs were determined by ELISA. In brief, 100 µl of polypeptide at 2 µg/ml, solubilized in 8 M urea, was added to each well of a 96-well EIA/RIA plate (Corning Inc., Tewksbuty, Mass.) and incubated overnight at 4° C. All remaining steps were performed at room temperature. The plate was washed three times with PBS wash buffer (PBS containing 0.05% Tween 20) followed by the addition of 200 µl/well sample buffer consisting of PBS containing 0.05% Tween 20 and 1% bovine serum albumin. After 90 minutes, the sample buffer was replaced with 100 µl/well PBS sample buffer. Serial ⅓ dilutions of the primary antisera were performed in the plate by the addition of 50 µl to the first row, mixing 10 times, and transfer of 50 µl to the next row. The plate was incubated for 90 minutes followed by three washes and addition of 100 µl/well of an HRP conjugated goat anti-mouse IgG, heavy chain specific antibody (Jackson ImmunoResearch Laboratories, Inc., West Grove, Pa.). After a 90 minute incubation, the plate was washed four times followed by the addition of 100 µl TMB/well (BioFX, SurModics, Inc., Eden Prairie, Minn.). Color was allowed to develop for 30 minutes, and the reaction was stopped by the addition of 100 µl stop reagent (BioFX, SurModics, Inc., Eden Prairie, Minn.). The absorbance was measured at a wavelength of 450 nm, and the titer was calculated as the inverse of the dilution corresponding to an absorbance of 1.0. Controls included a standardized primary serum included on each plate to monitor assay variability and wells that were uncoated to subtract background. The limit of detection for the assay was the inverse of the initial serum dilution (indicated as a dotted line on FIG. 7).

All eight rBIRPs were highly and equivalently immunogenic, eliciting antibody titers greater than 100,000 by ELISA (FIG. 7). This included the response to the polypeptide reflected n SEQ ID NO:8, which was identified solely through bioinformatics analysis (Example 5). Vaccination with the purified subunit vaccine also resulted in detectable antibodies to all eight rBIRPs, although the overall titers to the rBIRPS were lower than in mice immunized with rBIRP8. This indicates that all eight rBIRPs were present in the PSV which, having been derived from the extract, indicates they were also present in the extract vaccine. It also demonstrates that antibodies to the B. thailandensis E264 PS vaccine cross-react with rBIRPs from B. pseudomallei K96243, further highlighting the conservation of these polypeptides across species. Moreover, antibodies to the polypeptide reflected in SEQ ID NO:2 were detected at a titer of greater than $1 \times 10^4$ in mice vaccinated with insoluble extract. The polypeptide of SEQ ID NO:2 was one of the polypeptides in the extract based on the iTRAQ analysis in Example 4, and the immune response to this polypeptide suggests it may have been involved in the protection observed in animal efficacy studies described in Example 6. Serum from immunized mice was antigen-specific, since neither preimmune serum nor serum from the placebo reacted with any of the eight rBIRPs.

Western Blot

Antibody specificity was further evaluated by western blotting. Each rBIRP was electrophoresed on a 4-15% TGX gradient gel and the gel was blotted onto a nitrocellulose membrane. All membrane incubations were performed on a rocking platform at room temperature. Membranes were incubated for 1 hour in Odyssey blocking buffer (LI-COR Biosciences, Lincoln, Nebr.) diluted 1:1 in Tris buffered saline. The blocking buffer was decanted and replaced with the primary antiserum diluted in Odyssey blocking buffer as above with the addition of 0.05% Tween 20. After one hour, the primary antiserum was decanted and the membrane was washed three times for 10 minutes each with TBS containing 0.05% Tween. The final wash was decanted and goat anti-mouse IgG (IR dye conjugate, LI-COR), diluted in the same buffer as the primary antibody, was added at the dilution recommended by the manufacturer. After one hour the membrane was washed three times as before, rinsed with TBS, and dried overnight in the dark. Blots were imaged on a LI-COR Odyssey imaging system.

The results from western blots paralleled those for the ELISA (Table 8). Antibodies to all eight rBIRPs were detected in serum from mice vaccinated with either rBIRP8 or the PS vaccine. The polypeptide of SEQ ID NO:2 was detected by serum from mice immunized with the extract vaccine, and similar to what was seen in the ELISA, this polypeptide appears to be highly immunogenic for eliciting an antibody response.

TABLE 8

Reactivity[a] of antibodies to individual rBIRPs on Western blots.

| Serum source | 1/Dilution | Polypeptide on blot (SEQ ID NO:) | | | | | | | |
|---|---|---|---|---|---|---|---|---|---|
| | | 1 | 2 | 3 | 4 | 5 | 6 | 7 | 8 |
| Preimmune | 1000 | − | − | − | − | − | − | − | − |
| Placebo | 1000 | − | − | − | − | − | − | − | − |
| Extract | 1000 | − | + | − | − | − | − | − | − |
| Purified subunit | 500 | + | + | + | ++ | + | + | + | + |
| | 1000 | − | + | − | + | − | − | − | − |
| rBIRP8 | 1000 | +++ | +++ | +++ | +++ | ++ | ++ | +++ | +++ |

[a]Reactivity was assessed as: − (not detected), + (low), ++ (moderate), or +++ (strong).

Antigen-Specific Cytokine Production by Spleen Cells

At termination of the experiment on Day 56, spleens were harvested, processed into mononuclear cell preparations, and cultured individually with 10 µg/ml of individual rBIRPs or the purified subunit. After 48 hours, the cell supernatants were harvested and frozen at −80° C. until assessment for cytokine production using a cytometric bead array kit (BD Biosciences, San Jose, Calif.) and flow cytometer (FACSCanto2, BD Biosciences, San Jose, Calif.), performed according to the manufacturer's protocol. The net production of cytokine for each polypeptide stimulus was calculated by subtracting the corresponding value for the placebo group.

TABLE 9

Cytokine recall response of spleen cells from mice immunized with iron-regulated polypeptide vaccines.

| Stimulus (SEQ ID NO:) | Vaccine[a] | Cytokine Production (pg/ml) | | | | | | |
|---|---|---|---|---|---|---|---|---|
| | | IL-2 | IL-4 | IL-6 | IL-10 | IL-17 | TNF-α | IFN-γ |
| 1 | Extract | 2 | —[b] | 2 | — | 1 | — | — |
| | PS[c] | — | — | — | — | — | — | — |
| | rBIRP8 | 19 | 2 | 14 | — | 35 | 11 | 19 |
| 2 | Extract | 4 | — | 4 | — | 13 | — | 2 |
| | PS | 2 | — | — | — | 15 | — | — |
| | rBIRP8 | 43 | 5 | 200 | — | 491 | 260 | 480 |
| 3 | Extract | — | — | 2 | — | — | — | — |
| | PS | — | — | — | — | — | — | — |
| | rBIRP8 | 7 | 1 | 5 | — | 10 | 3 | 4 |
| 4 | Extract | 1 | — | — | — | 2 | — | — |
| | PS | — | — | — | — | 2 | — | — |
| | rBIRP8 | 15 | 1 | 26 | — | 57 | 41 | 43 |
| 5 | Extract | — | — | 1 | — | — | — | — |
| | PS | — | 1 | — | 4 | — | — | — |
| | rBIRP8 | 26 | 4 | 38 | — | 101 | 30 | 94 |
| 6 | Extract | — | — | — | — | — | — | — |
| | PS | — | — | — | — | — | — | 2 |
| | rBIRP8 | 7 | 2 | 220 | — | 251 | 405 | 624 |
| 7 | Extract | 2 | — | 23 | — | 6 | — | 5 |
| | PS | 2 | — | — | — | 1 | — | 6 |
| | rBIRP8 | 10 | 4 | 229 | — | 215 | 211 | 329 |
| 8 | Extract | — | — | 2 | — | — | — | — |
| | PS | — | — | — | — | — | — | — |
| | rBIRP8 | 20 | — | 11 | — | 56 | 6 | 20 |
| Purified subunit | Extract | 2 | — | 293 | 15 | 2 | — | 1 |
| | PS | 4 | 2 | 503 | — | 13 | 164 | 10 |
| | rBIRP8 | — | — | 17 | — | — | 10 | — |

[a] 5 mice were tested individually in each vaccine group
[b] —, below the level of the placebo group (background) or below the level of detection for the assay.
[c] PS, purified subunit Recall responses to individual rBIRP polypeptides and the PS vaccine polypeptide mixture were observed in all three vaccine groups (extract, PS, and rBIRP8, Table 9). Negative control spleen cell cultures incubated with PBS did not exceed background levels in the placebo control and therefore are not shown. Mice immunized with the extract vaccine demonstrated low but measurable production of IL-2 and IL-17 in response to four of the eight rBIRPS (SEQ ID NO:1, SEQ ID NO:2, SEQ ID NO:4, SEQ ID NO:7). In addition, the polypeptides reflected in SEQ ID NO:2 and SEQ ID NO:7 stimulated production of IFN-γ. The pattern of responses was similar though not identical for mice vaccinated with the extract or PS vaccines. Most notable was that both groups exhibited a strong IL-6 response to PS antigens. Mice immunized with rBIRP8 tended to exhibit stronger cytokine recall responses to individual rBIRPs than mice immunized with extract or PS vaccines, suggesting that responses to IRPs can be boosted by decreasing the complexity of the vaccine composition and increasing the amounts of targeted IRP antigens. Moreover, the Th1 (IFN-γ, TNF-α)/Th17 (IL-17, TNF-α) type of response observed for rBIRP8, coupled with IL-2 production to promote proliferation and an undetectable IL-10 (regulatory) response, is intriguing since IFN-γ is generally associated with protection to intracellular pathogens, and IFN-γ, TNF-α, and IL-17 have been implicated in protective responses to *Burkholderia* infections.

Sequences

| ID* | MW | Protein GI# | Protein Locus# | SEQ ID NO: | Sequence |
|---|---|---|---|---|---|
| 401 | 81 | 83718630 | YP_442936 | 26 | BtE264-400 |

```
   1 ttaccagttg tatttcgccg tcgcgatcac ggtgcgctgg ttgcgcgtaca tgcacaccga
  61 atccgactgg cagccggcca cgtaacgcgt cgtgaacagg ttcgccgcat tgagcgcgaa
 121 gcgccagttg cgccagttg tcgcgggcg agtgcgacgc agcggtgtag ctcgcaccgt
 181 cagccagttg tcgcggccgc ccgccgcgcg gctcatgagc gcacgcccg cgcgacgcg
 241 gaagcccgtg acgccgacgg gccactgtt ccagcctgcc gcagcgacg cgatctggcg
 301 cgggcgggc acgtcggcg acgtcctga tagacgtcg cggcgatcac cgacacagt tgccacccgc
 361 gctcagtccg acgcgcgg acgcgcgcg agcgcgcgg agcgaacctg acgaacgtg tgctcgtcgg
 421 atcgttcga tgctccatcg cgacgtcgt ctggtgatc caggccagcc tgtagacgg cccgttcag
 481 catcaggttc ttgcccggcg gtgccagcg gtgccagcg caggccagcc tcgattggc ggccttggt
 541 cggcctcgcg agccgcgg ccgccagtc ccgccgactt tcgccgactga acgacgtga
 601 atagtcgagg tacgccgcg gcgtaatc gccagatag gtcaggcca acgacctga
 661 gaacgtgg tgttctgct tgaagctgc cgagtcgcg atgtcgtcct gcgacgtcg
 721 cgtccagtcc tgccggccgc cgagcgtgaa cacccagcgc tgccactga tctggtcctg
 781 cacgtacagg ccgaaggcgt tgacgcgt cttcgtcgg gtgcgcgggt acgcggtcgg
 841 ccggtgaag atgcggccg gaatcggct gtaagcggg cggtacaggt tcaggcccgg
 901 cccttcgcg agccattcgc tgtcgtcgt cgtcctgccg ttgtagtcga agcgaacag
 961 cagtgtgtgg ctcaacgggc ctgtcgtgaa tttcgcctgc gcctggttgt cgacgtcgaa
1021 gcgctgtag ttgaactgga acaggcccgc gtagccgcgt atgcgccca tcgcgggtc
1081 cggcctcgcg agccgcgccg cgtagaacga gtcgccgat agccgcagg gcatccagcg
1141 cagttctgc cggaactgcc acacccgggtt cagctcgtcg tcgaactgat agccgatcga
1201 ccattgctc ctgggtagt gctcgaagtt cgcaccagcc gtgacaggt cgtccgagat
1261 catccgttc ggattcggca gcacgtgcc gcacgacgg aggagtgc aggtcgtc
1321 gccccagtt tgcaggatg tcctctcac gcgagcgatg gtgttggcgt tcggctgca
1381 cttagcgac ggcgcgaacg acaccgctg gcgcagagc gcccccgtc ggccgttgcc
1441 gtcgcggccg acgcccgga cgtgtgtcgg cacctgcagc cagcctgcca tcctgtcga tcttgtgcc
1501 cgtgaagccg atcagctgct gctaccagtc cgaggggttg tccgatccgt aggtcgagaa
1561 gatctcgaac atcagctgct gctaccagtc cgaggggttg tccgatccgt aggtcgagaa
1621 cgctcgccg ttccgagct tgtctcgac gtcgacgat gcgcacgatc cgatctgctg
1681 gtacagcacc gactcggggc cgactgtgca cctgacgctg tcgactcatgt acgatcgac
1741 gcgccagctc gacaggtga cgtgtcgg cgtaccagtc cacctgcagc ccgtcgacgc acagtcgg
1801 cgtgaagccg tcgagccgcg tagcgccg cgtaccagtc cacctgctgg tccgatccgt aggccgagaa
1861 gcccggatc tagcgcgg cctgattgat ccccgccgc cgatccagtt gcgatccgct cgatctgcgt
1921 cgcggcgcg atgttgatcg ctgcgggat gcgcacgatc ctcgacgctg cgcgatatcgg cttcgtgcc
1981 cgtggtgctg cgccgacg caggccgac cgaggccgcc agtgtcccaa ttccacctgac cgccgaacac
2041 cgagtcgcg ggcaacgcg tagccagtgc cgccgccgc agccagcagt tcacctgac tgcccggctg
2101 cgccgggg tagcgggcg gcgcacgaa cctgatcgcg gcacagccag tgaactgcgt cgcgcagaa
2161 cgccgccgt gccggcgc gcccgcacg cgatccgcg cacccgggtg ctggttgcc actccat
```

```
  1 mewatstrvr aiaaaagvaf caaashaqaq avrpgadarq pgsqvngdta aggtlpa

-continued

```
   601 vgnlsrelsv iaayvyqdvk nvqandntln kwpvdvprpr qiaslwadwt wrngpltgfg
   661 vgagvyrymsa aagaadnslt vpsytifdaa lhyelrnwrf alnatnlfnr ryvagcqsds
   721 vcmygnqrtv iatakynw 402   55   83717404   YP_440292

1 tcaacgtgc gcgacgtcct gcttgtcga ctcgcgcgaa ccgacggcca cgtcgttcc
    61 ccaaccgcg ccgagccgcg gaatccaggt actccagttt gaccgcgat accccgtcag
   121 ctgattcgac tgcaattgcg ccttcctga actgcgagca cgagccgtcg ctgtcgatca cctcgagata
   181 gctgcgacgg cctcctgat actgcgcgcg gaactgcttc gccgcgcgac gcgacgcgtt
   241 gaccgcatcg ctctgcgcgc ggatctgatc gtcgagcgg cgcgagatcg cgaggttgtc
   301 ctccacttcg cggaaccga cgagcacctg ctgcgactt tcgtcgaaga ctcgtcgta
   361 cttcgcgcgc gctcgcgga gtccgagcag accgagacg cgtcgaccga tcgcagcgt
   421 gagccgcgtg cccgcagtc gccgcttcat agccgaacga accgtgatg ctcgaccaca ggaacagatt
   481 gccgagcgtc gccgcttcat agccgaacga accgtgatg tcgagcttcg ggaaatacgc
   541 ggactcgcc agccgatgc gcgcgttcgc gcatcatc gcgcgctcgg ccgcgaccgg
   601 gtccgccgc cgtccctga gcgcgacgg gcgcgacgcg caaccccgcc ggcacgcgca ccgccgcgat
   661 cacgatcggc gttccttga acgagaaatc agcgcgcgcg ttgccgacca ggatcggag
   721 ccgtcgacgg gacgcgcgc gccgccgacc accccgaccc gagtccgcct gagacgtcgc
   781 gagtcgttc tccgcgcgg acacgtcgag ctcgcgcgag ctcgacccgt cgccttcgc tgaagccgcg
   841 ctgacgagc ttcagcgct ctccgcgca cgaagtagtt cgcctccca tcctcgagc gatcctgatc
   901 ggaatcggac cggcagcag cgaagtagtt ccgcctgcg tcgccgacga acccgagcg
   961 caccgagcgg aacagcgct ggctctgcgc ttcgtcgca cgaccgtg ttcgtccgca cgagcgagcgt
  1021 gccagtcggc cgaacagat ccgcctcgta cgacccgtg gaactgcgac gcccctcgcg
  1081 cgcgtcgtc gggccgtcgc ctgcgcgctg gcgcgacgga gaacgactgc gagcgggtcg cgcggtcgg
  1141 cgtccgccc aagcccacgc ccacttcgag gcgcgcgcg ggcctcagg tttcgttcg cgtcgagcgc
  1201 cgccgcgcc tgctcgaccga tgctcgacga gcgcgcgcg gccgaatacg gcgcaccatt cgcgcgcgatg
  1261 ctgcgttcg agcgcatcga cgggcgtcgg cgtcttcca cgtgccgcc tgctcgccg cgcgagcgc
  1321 cgcgcgtcg cgggcgtcgg ttgaacgcg gcaagcagcg gacatccggc gcctgctgt gcggccggc
  1381 cggcgttcc ttgaacgcg gcaagcagcg gcagagcagg cccgtcgatct cggccccgac
  1441 cgcgacgcg gcaagcagcg gcagagcagg cccgtcgatct cggccccgac
  1501 cgcgatcgt tcgttgatgt tggtcttt tt at 2
    1 mnktnineri arvakiaaas gllvallaac avgpdyrrpd vatpaafkea palapgeqag
   61 twktaepadd ahrgewwrvf gdpaldalet qalaanqnlk aaaarveqar aatraarsqw
  121 fpqyvgfgp treglspasq fpqgsgptn atlwraggtv syeadlfgrv grnveasrad
  181 eaqqalfrs vqlalqadva qnyfelrrld sdqdlyrrtv qrrifsegdis
  241 eldvsrakne lataqadsvg varrraaseh alaillgkap adfsfketpi vpvavrvpag
  301 lpsailerrp diaaaeramm anariglak sayfpkldit gsfgyeaatl gnliflwssrt
  361 fllgpfagta ltlpifdggr rsagvaqara kydeevanyr qqvlvafrev ednladlrll
  421 dddiraqsda vnasrraakl srtqyqegav sylevidser svlesqlqsn qltgtqavst
  481 vnliralggg wgndvavgsr epnkqdvaar 403   84   83716122   YP_439399

1 tcagtagcgc ggcttgagcg tgacgagcga ggcgcgatcg acgcgtagtg
    61 cgccgatag gctgcgatcg agtacgtcgg gttgtcacgt tgagcggac
   121 gtccgagctc gtcttgatcc ggtatgcgc aagccgtcg acgacggcac
   181 ccgcggcag tcccgtgt ccgcgacat cttgacatcg cgccgcgac
   241 cgtgaactc ggcctcact ggagtcgt ccatagcgt tcgcgtgtt
   301 cggaactg tacgctag tgccccgaac ccgccacc cttgccgttc cgtcttcag
   361 gtacgctag ctcccacg cgccgaac cttgccgttc gcgcggaga agccgagctc
   421 gagccgtg gtgcgatct tgccgacat ggcgcactg ttgtcggca gcgtagcgc
   481 ccgtccgtc gtgcgatct gaaagagc catgtgcg gcgcgcgag cgtcgagcac
   541 gttccactg gtgccgagct cgatctcc gttctctcc cgattcgtc ggtcggcgtt
   601 cggccgacg cgcctcgc gcccgagcg cgatgtgc tccgcgtc cgcgagcag
   661 cggccgccgg ggctcgacg ggctcgcgta acgtcggcg acgcatag atgtgccgg
```

```
 721 cttgaacacg aggccgagct gccagtcaac gagcgtgtcg tcggcgtgt agtcttgcc
 781 gcccgtccgc cgggtccgg tgaagccggt cgagtagtcg cgatcgtcg cgccggcgtt
 841 cacctggcca tgcttgctca gctcgaccgt gctcgagccg tagagcgatt tcgtcacggt
 901 gcgccatgc gcgtagtcgt tgtgcgcct gatcgagccc gccacggt cgtcggggtt
 961 cggcgaccac agctcgtgc agttcgtagc ggacagcctg atccattcgc gctgacagtc
1021 cctgccggtg ccggtccgca gctgacga atcgcgcttg gtcaccgca acagtccgt
1081 gatgccggtc gtgaagctgt gctgaacga tcgccgtcgg ttgccgcga agacggcc
1141 ctggtccgcg atgtcgtga tcgccgtgtt ccgtgccgg atgtagtcct ggtccgattc
1201 gtgatcacg tgccctggc tgtccctcgg ctgctccgag cgacggtg cgatccgcag
1261 cgtgtagcgc gtgctgtgc gcaccgtcag cgccggcgtg atgtcgtgct agaagttgtg
1321 cctgccgatg tccgacgtg tcttcgggaa gtcgagccg ggcttgttcg aggcgtgta
1381 ccgatcgacg ttccgcggat agatcgtgtc gggcagtcg gtccgtcgac agtcgcgt
1441 gaagtacggg atgccgcct cggcgaacgc gtcggtcgac agtggtagt agtcgcgt
1501 cacgggcgtg gcgctgccga tcgcgcggcg agtcgcgt gtcgtggctc atcaggttca ggcgaaacgc
1561 gttcacccgcg tgcaacgcg gcaaatcgg cgcagtcgg agttcgcga ccgggtagcc
1621 ccgtggtcg tcgcgctcg gcgcctcgg ctgtcgtgtg gagatcggc gcctcgtga cgaggttgat
1681 gagccccgg gcccgccgc gcccgcctc gcccgcgta cgcgcgtcc gagccttcg tcggcatcc cgtcgacga
1741 gctgcctcg ggtgaagatct cgccgcctg agccgcggat gaacgggtg cgtcccgcg gattgccgcc
1801 caggccgcgc tgggcctgtc agccgctgct agccgcggc cacgcggat gaaccgggtg cgccgacgag gatgccgcc
1861 ttccgcccg ccgaactgta tgccggcac cggcggaat cgccgcgc cgtgcgagc gccgccgc
1921 gccggcctcg tgatccagtt cggatccacg acgacgagaa gtcccgcttg tagtcgcgct tgtcgacgag
1981 cgggccggtg aattccaccg gcggccggca gtccttgtc cgatcggcg gtgcggtgcc ccggcggcc
2041 cttgacctg atcggccgcg aaccccggc tcgcgcgcag cacgtcgag agggtgtga atttccgag
2101 gtcccgcgcg atcgcccga tcgcccga tcgcccga tcgcccga tcgcccga tcgcccga
2161 cttcaactcg tcgaaacgcg acttcatcgg tggtattcc tgcgcaggtg tgactcgatc
2221 gggcgaagca acgcgctg catgatcgt tccgcccaa
```

```
   1 mggthaaav aspdrvtpge eippmksrsd elklgkfttl csvlaaspaf aqdaappaat
  61 adhdkelapi qvkgaaersy kadfsssvkf taplvdtpks vtvippelih dsgaatltea
 121 lrtvpgitfg agegnplgd rpfiirgydtq gslfvdqmrd tgattreifn terieitkgs
 181 dgaysgrrga ggsinlvtka phlgtaeas aglgtdryrr ftadgnwqfa dhaafrlnlm
 241 shnndvagrd avnnerwgya pslafglgtp trvtasyrhl stddlpdggi pyfytasnkp
 301 anvdtiypan vdrhnfyglv vingrvwrn nmrnsainsi igtlriehdi tpsltvrntt rytestqyi
 361 wtqpddsqgn vingrvwrn aasgynctsl wsppnpdpwa gsirrnndya hartvtksly
 421 krdysvatg tghkicqggig dystrfctdr anggktytrd dtlvnwqlgl vfkpapngsi
 481 gfdtvelskh wqvnagvrid qyamvgskrv qgleigfsgr ltrawqvfgg ytylkselre
 541 yasyatstp agallgegae tgsltpgrgg vgsnadqlap kftvggafy mskvfgdtan lravpsywrf
 601 ltaalfqidt tnarvtipnn qfpntpkhsf tlwtnydvtp ypahyasiap grsafvtlna
 661 ngkntadkgh qfpntpkhsf kldvrinvnn lfnrtyfdqa
 721 damaqyrink
```

```
404  83  83717803  YP_440327

1 gtgcatcaac ctctgctggc gggcgccg cttccgcccg cgcttccgc ggccttcgg
  61 ctctacgcg cgcgcgcg gccgggccg gccggccg aaccccgcg gcgccgccg
 121 ccgtccggcg cgtccgcga gcaagtgca cacgctgcg cgggcgcaac acgccgcaac
 181 gcggccgccc tcgacccga aatccaccga tccgacctcg gcgacgcga ccgagccgc
 241 acccgggcga gctatcgcga gccgccgtca gccccggcgc gtcaccgc agaaccagca ggccgacacg
 301 atcaaggacg cgccgtcgcgc cgcccggcg gtcaccgtgc gtcccggcgc gatcaaacat cgcgccctc
 361 cgaaggacg cgcgcctgt gatgaaagcc cggcccggc gcatcgcgc tgccggcgtc gttccggttc
 421 gaagcaaacc gcttcgc aagcccggcg cggcccgctc ggcgacgcg gccgatttcg acagcgcagg
 481 ggtccgcgctg atctgcgcg cccgggcctc gtcgtcgcgcg gccgacgacg gccgtcgacg cgccatccag gcgcatcgag
 541 atctgcgcg acctgcgcg ggcctcg tcgcggcgac gcccgggcc gcctgcgacg cgccgtcaac gcccgtcaac
 601 ttcatcacga aagatccgtc gatctgctg cgatcctgc tcgacccacg ggcgaagagac ctattcctcg
```

```
 661 ttcgggccga gtcgacgtc ggtcgacctc agcgtcggc ggcgtcggc
 721 ggcaacgacc gcgtgcaggg gatgctgatc cgcgagcgcc gccgagcca cggagtcgac
 781 acgcgcggcg gcgacaattc cgcgagcacg aagccgcaag ccggaatcc ccaggatgtc
 841 tacacggaat cgctgctcgg caagctgacg gcgccggatc gacaagcga cgccacgca cacggtcaag
 901 ctcaccgccg agacggtgc gcgcccgatc gcgccggagc agccacgcct gcaccggag
 961 ccgacgacgc tcggcctcac ccgcacgagc gtcaacgtc ttccagaccg gcaccggac gctctactac
1021 tacgattcc gcagaacgc aacaggatca ggacgcgtc gagacgcgcg gcgcgcgcc gcaatccgc
1081 caggaatcga accattacag cgagcgcggc ttcggcgggct ccggttcgc cgagggcggc
1141 tctcgctcga ttcgacccg ggccgctcgc gccacagtcg ctgtacggcg tcgacgacgg catcgaccgc
1201 atcaagagcc tgcgtgccag ccgtccgcg gacgcgctg agcccggcg agtcgttccc gaacaaggcg
1261 tttccggaca ccgactacac gctgttccgg gcgtgtgc gctccggg gccgctcggc
1321 aagctcgtc cacgccggg cctcgcttc gacgcatatc ggctgagcc gccgcggcc
1381 gatccgtctt tcaccggcca gacggtcagc gccccgatc acgagtgtc acgagtacgc gccggcttt
1441 gcgtgcgtgt aagaggtgac agctcctg agctcgcga acgaaca agctcatga tggctatca
1501 cgcagccaa cgcccgacca gtcaacaac agctcctga atccgatcga cgtcatcga gtcgcagca
1561 tcgatcggca atccgaact gaagcccag cgggccgtg gcggtgtc cgggcccgg cggccgccgc
1621 gggcagctcg cgacggta tcatccgca cgaggcagc ggcggcagc gttcacgga cgatccgctc
1681 tgtatcgaact catccgcg aagcgacgcc cagcgcacgc gttcacggg cagcccgag
1741 tggtccagt acgtgaactt acgcaactg caccggtgg accggtcgaa gggcacgacg
1801 cggacaacg gcggccctt ccacgggctc cgagcgctc ttccggcag accgttctc cggcgttc
1861 ggcgtgcgct acgacggcag cgagcgctgg gtgctgcggc gtgcaggc ccgacctgct gtccaggcg
1921 cggaagccga actgcgcga cgcgccgat ggctacctc tcaacaagca agaaggcgg
1981 ccgctgctcg tcacaaacct gttcgcgcgg ggctacact ccggcggc agcgtcca cgtagcgcc
2041 tactctggca ttcacaacct gtcgaccgc gtcgacgca tacaccgctc cgggccgcag cgcgcggtc
2101 atccgcgccg attcgacgct tggattctg a
2161 agcatgaagg tggattctg a
2281

1 mhqpllarrp lraalfgafg lyaaaraag aasepaaaap psaasaapqvr haasaatrgn
 61 aralpitvt attasaasr sdleeqqadh ikdalryepg vtvrrtayrp
121 analgggrd gdsinirgl egnrvlmed girlpsafsf gpleagrgdy adltlkrie
181 ilrgpassly gsdqltgavn fitkdpsdl sihgkktyfs lrpsydsvdr svgaavaaag
241 gndrvgqmli asgrrghevd trggdnsast krttanpqdv ytesllgklt itptprdtfk
301 ltaetvrrri dtnvlsainp pttlgitand klermlsid ydfrddasrw fqtahvqlyy
361 qeskqdqaf etrggrlqsr srsnhyesra fggsafaesg fatgplahkl lygvdgsidr
421 ikslrdgava spgesfpnka fpdtdytlfg afvqdgigfg kllvtpglrf dayrlspsag
481 dpliftgktvs ssdhelsprl avlyevtpal ipyaqyahgf rtpppdqvnn sfsnpiygyt
541 signpnlkpe tsdtleaglr gtlgtgypl rygvaafagr yrnflaqrmi gggsrpndpl
601 vfgyvmftna rihgfegrae wwmpngtlk tamaftkgtt rdngaasepl dtvnpfsavf
661 gvvrypeserw faqadllga gkrgrdvssa acrektcftp pssfrvdlrg gyhfnkhvsa
721 ylgihmlfdr kwynnwsdvrg iaadsnvlda ytaprgrsvav smkvdf 1 tcagaactgc ccgcacacg tcagcatcac gttgcgcggc tccccatggc gattgttcca
 61 gccgggctgg ctgagactc gtgtaagtt agcgatagcc cggtgtgaac aggtgttga cgttgagcgc
121 gggtccat tgctgtcgt acgcgatagcc ctgacaccgg gcgagaatg ctcgcaccct gtagcgccc
181 ctgtcgcatc caggcccgt gcacgggcgt ctgcccacgg tctgtccaca aggcagccag
241 gccgatgctc acgtgcgtc gtagctcgcg cctggaacgg ccggccgtag agcgcagcag
301 gtgcgtgtcg aactgtagc cgtgaactg gtgccccacac gtccaccac gcccgatgc gccgttcgc
361 gatcgtgtcg acctgtagc gtccccacac tgcccacac ggcgacgatc acgtagctg gccgttcgc
421 ctcgaattcg aagccctggc gtgtcggcgg cccctgcgg gccagctgct attgtatccg agtccggc
481 ggccatggaa tgtgcggcat ctggtgccat cgacctgcgg cggctcgggg gccgtttatcg gaaccgcgc
541 gagcgaacg ttgagcttgc ccgcgacag ctgagcatcg ctcccctg acgggtcct ataccggtct cgtaggtgcg
```

405    81    83716062   YP_440017

30

```
601 gccttcacc ggctgcagga ctccgtacc acgaccagtc tgtgtcgcgt ccagtcggca ttgtctgcg gctggaacac
661 ttccgcatag ctccgtacc acgaccagtc cgtgtagtg gcgcgcgaca gcgcgcgatca tccagatca gcccgccata
721 cggcgtgaac tgggcggcg ccagcacga gctgtagtg cgctcgagg ctgcggag ctgtcctggc tccaccagt
781 cacgcgccg cccagcccg atcgcacgc cggacacgtg cctcctgcgg gtcctgcga ttgatgcgg cgaggcgta
841 gacgccttt tcgagatgt cgttctgca agcctgcat gtcctggg tgctcgccgc taccggtc
901 cggcacgctg tccggatcc agcggtacac gtcaccgg gtgccggcg ccgcagcag
961 cggcgccg agtgccgt ctgtgccctg acgggttc cacgtcgca tcgacgtg gcagtcgtg
1021 cgcgcgcg aacgcgcga ccgggcctg cggggcccca gccgaccgc tcgacgtgca ggctatagcc
1081 gctgaactgg tatgcgctc ccatcagcgt gccgccgca gccgcaccgc ccctgagcc gatcgatcgc
1141 gccgtacgag cccggtatt tcaggtcgga gcgcaccgc tgatactcgc cgtcaccag
1201 tgccttccag cccgcgcga gtctctgctc gacgagcga aacgcgcg tcgatccca
1261 gtgaagttg cctgaggtg ccgcaggaa tgtcgacac gggacacgac gcagcgcg ggccgagcc
1321 gtcgcgccc atcgcacgc cggacactgc gcgcactcg gcgaccgact gtattgcgc
1381 gcgaccgtg acagccgtg acagcctcg gtcgtggtc gcgactccg agatcgacg
1441 cgtatcctgc ttcgcggat gtgccgcga ggttcagcgg accggtcc tcgtacgg cgagagccg
1501 cccgcgcg gtgccgcgg gtgcgcg ctgtgcctt cgcggccgca tgtcgtagcg ctcggtagcg
1561 ccccaactg cgatgtcg cgctggccgt tcgcccgg cggggaaca tgatatggcg ccgttgcg
1621 caccagattg acggtcgcg cccggattgc ggagccgtgc ggcaagcgt tcgccgcg
1681 cagatctcc acccgctcgt acaccgacat gtcctggcg gagctgcca tgtccgcga
1741 cacgaaccgg acccgtcga gctccaacga atccaccttg aagccgcca cgaagtacgc
1801 ggtctcagc agcacgtatg gctgtctgct gctcgatccg ctcgatcg gactgctgca tcagtcgtc
1861 gagctgaac agttcctgt gctgcggga ggggtc gtcaactga ccgattgcgc
1921 aatctcccgc gtcgcgag cgctctaccg catctctgcc gacagtcgcg atcgacgg gtccgccgc
1981 atccttgcgc gcgcttaccg aaatcgcctt caactgccgc tctgctctt gtggtcgc gtgccggc
2041 ggctcgtgc cgctgccct caccggggtg ggcgccgatc agcatgccca tcttcgcggc
2101 cgtccggca aggcccccg cgccttcccc caccgggtg ggcccccgca agcatgccca ggcaaagcga
2161 cgaacgcac accctgccc ccgaaaccgc caaccgcgcg gccccgcgc gcatctctc
2221 agctcccgcc acctcgtact gcat 1 mqyevagper srrvaapygr fggrwrssl clgmlaahp gaaalagtaa ksdtqknesv
 61 qegtrqraag arpaggelka isvsaskdaa ddpsiatvgk mplalrelaq svsvttreri
121 eqqnlfsldd vmqgsagytv qpyvlltay fvrgfkvdsf eldgypvvlg dmasspqdms
181 vyerveillrg anglhgssn paatvnlvrk rpqyqfaana sasigswgry raqadigspl
241 npagtvrgrl vaayedrgff ydrakqdtrs iygiaeidvt rdtlvtvgaq yqsvasvpdm
301 sgypmardgs slglsrstfl drvgwhfdwd ttrafgsveq kiggwkalv sgeyqavrsd
361 lkyagsygai dratgaggtl mggayfdsgy srsvdanvqq pvrafglahe llfgatyass
421 snglqisapll agaatpvnvy rwnpdsvrep gigpyrqdmq ndisqkgvyq lgriklaqpv
481 tlvlggrvsw wsqslgahy nagrqftpyg gliwdvardw swyasyaevf qpqtkptwdg
541 silpvkgrt yetgikgels gqklnvelaa fridldnnpq vdaahpcagr scyvnggsv
601 rsqgfefean gritpwwsvw asytfdtiry akdvanggaf aaeltpfrhl rlwtnydipw
661 qerrwsigg vqvrysdfsaa sngvtmrqgg yalasvrlgy rydrqwsaal nvmnlfdrty
721 yqslsqpgwn nrygeprnvm ltvrgqf 1 atgcaagcgg gacccgggtc ctcgcatgcc gatgatcggc gttcggccgc gcgcgcgatg
 61 ccatcggagtc gacgggagtt gacagagcgg gacgagccg aagcgccgc gaacgttcg
121 gggccgcgtg gccgcgacga cagcgggaag tggggggcag tgctcggtcg gggcggtga
181 cgagccgcaatc cgtcgatag cgggccgcgg cgcccgtgct gtcgagccgt cgggccgc
241 gacagcttcg cggccgcgg cctcacggcg cgcccgccc tcgcaccgcc gctacggccg
301 caccggtcg cggtgacgc gtcgccgcg ctcgccgccc tcgaccgccg acgcgaacc ggcgaatcc
361 ctcgcgcgc cggtgacgc cgatccgcg actgcgacc gtgcgtcga gtgccgtga gccccgcgc
421 gccgcgacc tcgcgcgcg ccagcgcgct ccacgccggc cacgccggc tcagatgccg ggcacgacg
481 tcgccgctgt ccaccgcat tcgaggcgat actgcgccgg cacgtcgcgg cagatggccg cctcgacatg
541 cccgagcgg tcgaggcgcg tcgaggcat cggtccggg cacgtccggg cggcggcga tcgcacgatc
```

```
  601 gtgacgccg tcacgccgt gacgggcttc agcaaggccg cggggccgg caacggcggc
  661 acggcgctca gcgtgcgggg cttcgcggcg gggaatcgg tgacgacggc cgtcgacggc
  721 gtgctctct acccggccgt gggcaccgtc acgttcccgt tctcgacgtg gtcgccgag
  781 cgcatcgagg tgctcgcggc gggccgcgt gtgctgcacg gcgaagcggc gatcggcggc
  841 gtgtcgatg tgtgcacgc aggccacgc gcgaacgat cgcgaacga cggcgcgagc
  901 atcggcacgc aagggcaaaa gcgcgtgggc ctcgaccga cgggcgcgct cggccgcgt
  961 cttcttatc gttccatct gagcgacgag cggcgccgg aagctcgatg gctcgtcga tttgtcgatt
 1021 gcgccacgga cgctcgatt acgactacg cggccagaag cggcgacct cgaactaca gcggacgat
 1081 acgctcgatt acgactacg cggccgcgcg gctgccgag cgcaactaca acgtcggcga cggacgatc
 1141 aacggcgtgc tcgaccggc atacctgaac cggcttgcc cgcgcctatc acgcggggca ggaatcgtac
 1201 gcttaccacg atacctgaac tcgccgacg cgcgaccatt ggcgcaacg atctcgagat cttccatcgc
 1261 ctcgacgcg agcctacta cggggcgcg cacgtcgcg cgcagcgact cgcagcgatt cggcgccgg
 1321 gcgctcgacg cggcgcgcg tcggcgagcg cttcaccga cagttcaac cagagcgact cgcagcgatt gacaacgcg
 1381 gagcgcagt tcggcgagcg gcgaatccgc ctgcgcgag cagccgcgt atccggggcg gtccggagcc
 1441 aaccgctcg tgtcggcgc cgctcgcgg cttcgacag cggaccgag cgcacgcgg gtcatcgag
 1501 ccgtatccg gcgaatccga cgcgaccgat cgcagcgatc cgcagcgatc aggcggcggc gtccatcgag
 1561 cccgatcga agctctgcgg cgcgctccgg cgggcctcgg tgggtgagcg ggctcgtta cgaccattg
 1621 aaccgctcg agtcctcgc gcgacgatct gtcggggcgc gtcggggcgc tgggtcg acaagacgt cgccacac
 1681 tcgttcacc gcgacgatct ctacgagatc ctacgagtgt ggcgctcgc gtcacgccg tgaccgcgta cgccaatac
 1741 ggctggcgca gcgagggcgc cgagagggct ggctcgcgcc gtcagccgc acgaatcga ggccgcgc
 1801 acgacggggcg cgggccgca atggaagcg ggcgcaagc gtcagcgcg acgaatcga cgcagccgag
 1861 acgctcgacg ccgggccgcg ctacgacatc gtcagcgcg gtcagccgg gcctcgtcag cgtcgaccg
 1921 gcgtactgga cgtcgcgcgt cgtacgacga gtcagcgcg cgccagccg atccggcgcgt cgaactcgcg
 1981 ctgaatccgg cgcatccgcg gtcgcgcgg cgcacgcaa atcgaccaa acgcgcgtt gctgcgcg
 2041 ggcgcgtgc gtcacgacg ccttccgga cgccgcgga gacaccgcgg ctgcagccc gggcaacgtg
 2101 cgtacgacg ccttccgga cgccgcca ccggccgaac ctgtgatcg gccgcgcgt gctgggcgct cgggccagc
 2161 ccgcacgaca tcgccgcga ccgggggctt gcttactgc ggcgctcgc gggcgacga cgcgaaccgc
 2221 tggccgcga atgcggggct ccgctgacg ggtcttcgc gccgctcgc cgtgcaggc gacgccgac
 2281 gtgccgcgcg cgctctacg cgctctacg gcgcaacctt gcgaccgta cgtacgcggc gtcgacgcg
 2341 gtcggcctcg cgctctacg cgctctacg gcgcaacctt gcgaccgta cgtacgcggc gtcgacgcg
 2401 aacggcggcg cgcaatggct gctcggcccg tcgcgttcgg ccgcgctcgt ccgcgacgct cgcgacgtg
 2461 cgcttctag
```

```
    1 mqagpgssha ddrrsaaram psrlrestss eqseaggkrs gprgaddsga cgvrsggggg
   61 rgnpsmsraq hapsrirafe rsfaaaaara ahgapaahgp haclaaasrr staverevta
  121 lacavtasga qmaargdrti vdavtratgf vrvtsdaaha splstpltag sriklaslom
  181 pasveaitsg qmaargdrti vdavtratgf rievlrgpas talsvrgfag qesvttlvdg
  241 vrlypgagtv tfpfstwsae rievlrgpas vlhgeaigg vvdvtrrpr rersttlqas
  301 igtggekrva ldttgalgpr patyfgvpaa ngvldralre rtrgtvergd ahatavggal kldvdsrlsi
  361 tldydygrqk patyfgvpaa rdsyleifhr erqfgerfta atyragngvt
  421 ldaqlyylat rrhwrnaesy aldaaartva rsdyleifhr erqfgerfta ridsrvfgra
  481 nrlvvgaefn qlafdganna pyrgestvaa agfdpgafas pdptlprfrt rthqaaafie
  541 nrlevlprla wvsglryhdl sfhrddlvag gafdtfaht gwrsglvyei apgltayaqy
  601 ttgaegvgsl vtlpasqany tlatgrqwea gvkheiddar aywtlavydi vkrglvsvdp
  661 lnparaqgig rgsrgrvela ggvrlpggvt idanallra rydafgqrvg dtvvgragnv
  721 phdiarqtan lwigwafapg wranaglryv grrygddanr vpvpsytvfd aslawqatrd
  781 vglalyarnl antryaasts nggaqwllgp srsaelvatl rf
```

```
    1 atgacaatca aattcctga tcaccgtcac ccgcgcgcac tcgaccgtg cgccgtcgg
   61 cggctcgcga tcacgctcac cgtcccgcg ctcccgcggc cgccctcca cgccgtcgc
  121 gccgtccgc agaccgacga tgcgctcgac cgtcacggcg cgccgaccgg gccgtcgc
  181 gtccgaacg ccgggacag cgccgcatcg cgcgccgca cactccgc cggagcggc
  241 gccgcccg tgacgcgcag cgcgacgaac cgcgacgcag cggcgaccgc gcggaagca
```

```
 301 gcgatgctgc cgacgatcga gatcgtcgcg gcgccgaat cgagccgatc cgagccgtc
 361 acgatccga aacgcccgg gcttcgcgtc ccagccgtg cccgcgagcg acggcgacc ttacctgaag
 421 acgattcccg gcttcgcggg gatccgcage gcggcaacg acggcgacc ggtcgtcgc
 481 gggatgttcg gctccgtca gaacatctc gcgaacgga tcgcgctcg cgacgacgt ccggcgtgt
 541 cccggccgga tgaaccgcc gactgtgtac gactgtgtac agagctacga caagtgacg
 601 gtcgtcaagg gcccgcagc cgtgcgact cgggcatgcg gcttccagcg gcttcgtga
 661 ttcgaaccgg tcgacgccgg ctccaagacg cggcatgcg gtccagcga cggcagacg gccgacttc
 721 gccgctcgt tcggcgcca cgtcagaac tcgcaggatt acgaagacg aacgtcgc
 781 tacggcggg tgatccgaa ccatgcat gggacgcg gccgtcgg gctacgcg gaccccgac
 841 acgtgccgt ccaatggga caagtgaac gggacgcgg gctacgcg ctacgggc
 901 gcgacacgc ggtcgagtt cgacgcaca tttcccggc gagacttcg gctacgtc cgacaagaag
 961 cgcgggatgg acgtgcaca acggcgcg gcgcaggtc gcgcaggtct tctacaacga agccgatcac
1021 cacatccgcg acgtcctga tcgcatcgag gcgacgcgg gcgcaggtc gcacatgcc gatgcgcatg
1081 gtgatggaca actacacgt gcggacaaca ctgcacga gcacctcg cggcacgct ggtgttcacc
1141 gcctccgaag tgcccgccg cacgccgg gggctcgag acgctctga ttcgcgctcc
1201 gacgcgttca agctcgtgac tgcagaacta cgtgcagtga cagacgag cggcgaatc catgtgaac
1261 gcgatggga tgcagacgt gacctgact ccgtgaacga cagaccgcg cgtgcagcgg catgcagcc
1321 gcgccgcgt acatatcgcg cggcgagct acgtgaatcg gccgccgat cgtccgcgt gcgtttcgat
1381 gcggacttcg aagccgttt cgcatgcgg aagcgcgga tacaacgcg gcgccagcg gccgcatg
1441 agcaggcca atccgacagt cgacgatctc cgcagatctc gcccggga ggccggcg gccggccg
1501 cgctacgagc gcgactccg ttcctcgcc gtcacggg atgcggcat atgccggga gcgcaacgag
1561 caacgcttc ccgattattg gaaactgttc gcccgaaagc agaccgagc gcggcccga cgcagtac
1621 aacgcgttct cggcgatcaa agtcgcgcc cagcgcagc agcacgcag acgacgcag cgacttcatc
1681 aagacgcaca agctcgacga tgtcgcgcc gctacgacg cgcgacgc gccgccgtg cgtcaatgcg
1741 ctgtcgact acgcgacgg ctcgaggcg ctcgatgga cagacgacg gggccgcg gcgtttcgat
1801 cagatcatg gggcgagct cggcgagct tggcgccg tggcaaagcg aagccgcg gccgcagatg
1861 gcgcgctcg cgatgtcgg cgcggcttt gggcgcaa gtacaacg ggccagcg cagaagatg
1921 cgcgcctcg aagccgcttt aagccgcttt accaccgaa tacaacgcg gcgagcgg gctctcgg
1981 ctgcgcgaa tcgtcgcga atccgatctc cagcaggcg tatgccgtc gtgctgccg acgaacgtg
2041 aagacttcg gtccgagcgc ccgttccg gtccgcatc gtccgcatc gacaactgc ttacgcgag
2101 agcaagcgg cgagatctc tgcagtcgg ctccggtttc gcccaggct tgagctgc gaactgc
2161 cacctgaacc tcgccggca accgattc ggctatccg ggctatccg cgaactgc gtcacggaa
2221 cccggcggg cagcgtggggt tc tttage accaagctct ga 1 mtikflrhah parvdrarrr rraitcvpa avaqtddavh rhqalgatsg
  61 vandaargas saksnarane atavtrsath ratagaapea amlptieiva apestplvvv
 121 tdpktprqpl pasdgadylk tipgfasirs ggtnqdpvlr gmfgsrlnil angmptlgac
 181 pgrmdaptsy iapesydkvt vvkgptvly gpgasagtvl fervtprfkt pgmrfdgsvv
 241 ggsfgrndqn vdtvagtpdf ygrvianhah sqdyedgngr tvpsqwdkwn adaalgwtpd
 301 dntrleltag tgdgyaryag rgmdgahfrr etfgltfdkk higdvldrie aqvfyneadh
 361 vmdhytlrmp dptssmpmrm asevrrrtlg arvaatlrft dafklvtgvd aqsnrldsrs
 421 amgmqnygdk pwnpqanmwn agafgeltwy asdasrvigg aridyaaard krattgmkm
 481 smrnptfddl rsrvlpsgfv ryerdlaslp vtwyaigha qrfpdywelf sakrgpngav
 541 nafsaikpek ttqldigaqy kdkldawvs ayagyvqdfi lfdyatgsmg qttqatnvna
 601 qimggelgas wrplapwrfd aslayawgrn vqsgaplpqm pplearfgve ytrqpwsagg
 661 lwrivapqhr yalnegnvvg kdfgpsafg vlslhaqymv skavqisvgi dnvldkayae
 721 hlnlagnagf gypammpvte pgrtawvrls tkl 1 tcagaactgc agctcgtca gcagcgacac ctgccgcgca acacgaagaa
  61 ccggtcagcg ctcacgggt aatacgcg gttgaacagg tcttcacgt tcagctggaa
 121 ctgcagcttc tgcttgcga cgcgtgtcg gtagtcgcg aaagcatcgg ccgtccgta
 181 cggggcage gtgaagctgt cgaagctgt gccgccgcc gccgccgc acccgact agccgccgc
 241 cgcgccgatc cgcgccgt cgcgccgaa cgcgccgaa cacgcgcgaa gcgtcaga cggcgcgag 408   81   83717123     YP_439577

7

33
```

```
301 cgacgccgtg tgccgccgca cgttccacag cgttgtgccc gcgacagcg gcttcgt
361 cgtcttcgca tcgatgtacg ccgatgctcg cagcgctcgc gactgcgcc cgatccgcc
421 cgacaccgtc tcgttgtatt gcacaccgtg cacgtcttc ccgagctcg agtcggtctg
481 gtctcgcg tcgttgtatt gcacaccgtg cacgtcttc ttgtcgatct cgaagaacgc
541 gagcgtgccg gcgaagccgc tcggcaggtc gagcctcgcg ccgactcccc acgacgcgcc
601 ctgtcgggc gggtcgagc gtcgatcac gtagccgccc gacatcggg cgatccttga
661 cgtcggctc agcgactgcg tgcacttcgt gccgagttgt agcgcgtcgt tccacttgta
721 gacgatgcc gcgcggcca gccacttcgt gccgtcagg gcgcgcagcg cccgaacgg
781 cggcgccgc cggcgagct gctgtagcgc gacgaagcgc ggcgtgcca cgagaatcca
841 cttgtcggtc agatggatgc tgtccggaa gaacgcgac gggtgtgca gctggggtt
901 ctgatcgctg tggacgcg atacccgg gcggcagatg tcgcgccgt agactcggg
961 caggagctg aacggcgcc gatcggctt gccgcgcatc cggcgagtcg cgcgttgct
1021 gtattcgctg tcgacgcgga actgcacctg agctcgcgag cgtatcgcgt tcgcgtcgta
1081 gtcgacgtat gcgattcgt ccggatcgac actgtcgac cgtccgatg cgtactggtc
1141 gcgctgagc gtccggtg tgaggggtg agcgaggtg cgccgagga ttgaccggtg
1201 ggttccgg tgttagcgt tgcaacagat tcgattcg gcgccgtcg gtaacggct cgtcgaggg
1261 gaccttcagt tgcaccagat tcgattcgt gcgccgtcg cgtaccgga ctcgctcgg
1321 gcgcgcgcc ggatccga aggaagcgc cgtactcgta cgacagcacg acctgcgtgt ggcgcgcag
1381 gaagcatc aggaagcgc gcgctgtagtc gaggagcg ctgagagtg acctgcgtgt ggcgcgcag
1441 ccacgcgga gaccgcgca gcagagctc gcaccctcg gcaccctcg acctgcgtct gccgcgac
1501 ctcgtctgc tgatcgaca gccatcgc ccgcaatct gcgaagcgc gcaccaccg
1561 cgatcgaac gtagctcgc gcaccctcg gcaccctcg cttcgtacg agttcgatca cgcgccccgg
1621 gatcgcgttg gtcgcgtga cgccggctg gtcggcctg ctcggtacg agttcgatca cgcgttcgt
1681 gccatgacc gcgcacaca ccggactcg gcgagctcg gcgaagcgg acttcagc agcgcgcg
1741 cgcgtcagc gagcgccct gagcggcct cgatccgc agcggccgt ctccacc cgcattcgcg
1801 gtgtcgcag aagcccggct tcatccaggt gagcgcgcgt gtcgcgagg tgcgaggtg tgtgccctg
1861 cgtgatccg ctcacgtcg cgcagtgtc cgaggttg cgcagcag accgtcgt ggccgcag
1921 cagccgcgc gcaacgatgt gccacctcg gcgaagctc gcgctccg tgcaccccg cgtccgtcgt
1981 caccgaac gcccaccgga ccggacgct cgccacgga gtcgtagc gcgctccg tcgccgcac
2041 cgagaacgt ggcacgtcg gcgagctcg tgtcgtccg cgcagcgtt cccccgccg gcgctgtgg
2101 ccggcgggc gacctgacga ccggacgct cgccacgga tgcaccctg gcccggccg gcgaccgg
2161 cgtgcccgtc cagagccgt agcgccgt cgagccctcc ggccgcatcc gcgccgagc gcgccccgg
2221 gctttgcaa
```

```
   1 mqspglhgra daaaaldril tgtglvalrq psggytlvrs pagpaapsag aalatdttlp
  61 tvsvraasglh adsyraprea aglrsdapla evpqavniva pqvlrdqrpi nlddalanvs
 121 gitqntlgs tqdtvmkrgf gdnrdgsvmr ngmpivggrs lnattdsvev lkgpasllyg
 181 imdpgvinv vtkqpqltrh naisvlgsty ghgrnggelt fdstgaigds rlayrllvdq
 241 tneqywrdyg ehretivaps dmrgesnlvq vlsyeyrrfl mpfdrgtald prtneplaip
 301 arrldepfn dmrgesnlvq ltvdhqlapn wkahlgysyn retydanqir itavdpvkgt
 361 ltrendathg srstdsyaia yvdgrvtlag mrhdvcfgvd seyrqvyrad mlrqaiktpf
 421 sylnptygli ppstsvsaad sdqsdtlhta slffqdeihl slygsytqsl kptskiapms ggyvidgsta
 481 rgrpfrvntn lsgtkwlpra givykwndal slygsytqsl kptskiapms ggyvidgsta
 541 peqgaswelg akldlpsgfa gtlaffeidk knvlvsqynd atnqtdwrts grarsrgiel
 601 dvsgrigerw nvlasyavid akttedplya gnrlwnvarh taslaavyda gavfggddlr
 661 igaagryvga rpgdsansft lpayatadaf atydtrvgkq klqfqlnvxn lfnrtyypss
 721 vnrffvsvgd argvslittl qf
```

```
   1 ttactgcgcg gcttgcggtg cgcgcaggta gatcgcgacg cggcggtttt gccgcaggcc
  61 ggcttccgtc ggcgtgtcg cgatcgggtt cgacgcgcc atgccgggcg ccgacaggcg
 121 ggttgccgcg agccgcggtt agccgagcg gttcacgacg gcttgcgcg gattctgcga
 181 cagccgctg ttctggtcg ccggaccgt gctgccggt gctgccgacga ccgagccggt
 241 gatctgcggg ttctggttca gtcgccgtc ggtcgtcgc gaggtcgttc aggagcggcc tgaaggccg
```

409  27  83720098  YP_441413

-continued

| 410 | 19 | 83719210 | YP_441918 |

```
301 cgtgaccgcg tactggtcgg tgcgcgaacgt ctgcgaacgt gaccagctc gcttgagga
361 gccgtccggc tgccggtga ctgcctgcgc cgtctgtgc gccgacggc cgagcttgtt
421 cttgatcgct tgccagtgt aaccgcgac cgcgccgac agcgccgca cgcggccgc
481 gatcgcccgc ccctgccc cgcagcccg tgttcgtgc cgcgccgat ccgggccgc
541 cgtgccggtg cgaccgccg tgttcgtgc cgcaaccg gcgcaaacccg ccagcaggc
601 gccggcgaga gcgaaaacgg gcaaagcgt cgcgatttg gtattcatct tggtttcctc
661 tcttgagtga ctcgacaaga acaaaaaga actgctcttt cggggggc gaccgcgcg
721 ccgacgatca tgcaggcgcg cgacgcgctc gatcctgcg gctgcagtg ccgggccgt
781 cttcat mktapapdag riealarlhd rrragprrk sssfflssh sreetkmntk iatrlsvfal
61  agaallagsa qqgntavgt gtgaagagai galagggkga aigagvgalv ggvtgynwqa
121 iknklapsaq qtqtgvtcqp dgslklnvps svtfatcdqya vtpaftplln dlattlnqmp
181 qitasvvgyt dstgsaahng tlsqnragsv vnalacqrgva atrisaqgmg aspniadnat
241 eagraqnrrv eiylrapqaa q
```

| 411 | 24 | 83720431 | YP_441918 |

```
  1 ttactgttga tagacgaggt ccgcggcggg gttctgcgcc cacgacgctt cgtcgtgcc
 61 gagccgacc ggctttcct tgccggagct cacgcctcc atctccgaat cccgacgcc
121 gagccgcgac agtggcgac gggtcgctc tggccggctc tggccgagcg cgagttgta
181 ctcgtcgcg tgccgtgct gctgctcag cggtgatcag atgtggcgct gggtggtgt
241 cttcaggtat tgccgtggtt ctgcagcgttg gttcgcttc cggctgttca ccgagtagct
301 gtcgaaatcg aagtagacgc tgccaaggt cgagggcctg tttcctgga tcagcggcg
361 gacgtcact tgccgagcgt tcttcgggatt gttcgcgtg ctggtcgtg cgcctggt
421 cgcggttcg tcgagcttca cccccagttg gcacgcggcg agcgccgca tcatcacgcat
481 cgcgaacgcg agacgaagt ttttcgacat cat
```

| | | | |

```
  1 mmskklrlaf amlmigalaa cksgvklded anggavstq pnpenvaqvt vdplndpnsp
 61 lakrsvyfdf dsysvgdqyg pllqqhagyl kshpqrhili qgntdergts eynlalgqkr
121 aeavrralsl lgvrdsgmea vslgkekpva lghdeaswaq nrradlvyqq
```

| | 10 | 36 | 83720431 YP_441918 |

```
  1 ttactcgcc ggaacggtcg tcttctgcac ttcctgcgtg cgacttccac cgacttcac
 61 gcgggtgacc gggcgaggc ggggtcgacc aagcgatgag tttctttgct tgcaggtgtt
121 gccctgatc gggtcctgac ggggctggct tgcctgtgcg acctgttcg cgggacgcc
181 ctgtcgacg agtacgact tgacgcttg cgacgcttg cgcacactcg ggtcgttgta
241 ctgcgag cgatgcggt cgtgcagt cgtcaagct cgtcagctg cgccacac cgtcatcgcc
301 ttggactc tgccaagt gggccagt cgtcaagct cgtaatctg ggcttca gtatgccgt
361 gtcgaagcg aacggtcg accgtgcg cgtctgcgt cgcttgga tggcgcgac cgcacttgc
421 accggtgcg aaccgtccc gccctgccc agaaccatc gcgcagcag agtcgttcg tgcgttcat
481 cccacccat tcgcccgtg cattcaccca tggcttgctc acgggtttgc gcgacgccgg
541 caccgacg tgagcacgcg atgcaacgt aactcggta acctcaatga acgcagctt
601 ccggtcgca agcgcgaag gcttgga tggagcaag tcggtcaatg gcgcgacgtt
661 tgaagtta ttcat
```

| 412 | 40 | 83719322 | YP_442131 |

```
  1 mnklsklafi aatavmaasa saqsvpasrq avndnwvngt gewvwmngtn elcwrdafwt
 61 patanakcdg alvaqapapa pvapvapait sqkitvqadt lfdfdkailk pagkqkldel
121 aaklqgmvve vvvtgytdr igsdkyndrl slrraqavks ylvskqvpan kvytegkqkr
181 npitgntckq knrkqliacl apdrrvevev vgtqevqktt vpak
```

```
  1 ttagaagcga tgacgcagga ctgatataga gctgtgaac ggctgatgc acgatacgcc
 61 gccgacgcg ttgatatagg cgccgaggc ctgtcctcg cgtttgacctt tcgtgatacac
121 gccttcagg tagcacgccg tgccgtcgaa tcgcgttcga ccggtttgca ggttgaactg
181 attccagcc gggtgttgt ctgcgatagaa gcgtcctcga tacgcgtag agccccgcgac
241 cgtccatgc gcgctgatcg ggctcacttcg gttcgacttcg agttgttga aacgcatgaa
```

```
301 cgtccgtcg agccgatgc cgtcgacac gccgatgcg cccgagctga cgccgtgc
361 gcgattgacg ccgtcgacg gctgtcgtc tgaacacgaa gccggcgtc acgtgaatt
421 caggccgcg ttcgacacgg ctggccgctt ccgaagaac gtattgtcga gccgaccgc
481 gcccaagcg cggcgtagc tggccgcat tctgttc gccgccgt aactgcagg agccgcgcc
541 gacgttgaag ctcgttctg ttcgagagc gtacaacgc gccgaactc aggtgtgc agtcacgct
601 ctcgttctg ctcgtactg accggcgtgt tgatcggc gcagtgttc aggttgtcg tgtcgaacgg
661 cgtgtactg accggcgtgt tgatcggca gcgaatgc gcgaactgc gacagccg cgatgagtc
721 gtgggcaaac tgtacgcgt ccgaattgc gccgagcgt gccgagcc caggagccg gatgagacc
781 gacgacgcta tgctactgac gccgagcc actgcggc caggagccg gtctgctg gcgcagacc
841 gaagaacgc ccgggccga tccaacaca aaatcgctt caggccgccc gccatgcac tggccgcc
901 caggccccc cggtcgcgt gtaggtgga gctgactgc gacgaggcc gaccatgac cgctgcg
961 ttgttgttc ggtgagtgc gccggtctc tgccggtc gaacgccg gatgaggcgc tacagcgtca cgtgctttg
1021 cgcgtgagcg gccggtccga agaccagca gacgccaga gagaacagg acgatgaggg tcttttcat
```

12

```
  1 mkktlivaal sgvfataaha qssvtlygli dagitytnnq gghsawsqss gsvngsrwgl
 61 rgaedlgggl kaifvlengf ginngtlkqn grefgrqafv glshdqygsl tlgrqydsvv
121 dyigpsltg tqfggvqfah pfdndhlnns frimavkyt svnwaglkfg alygfsnsne
181 fanraysag vsysyaghfnv gagylqinnd fgptvsnasg avaldnetfvg krqrvfgggl
241 nytygpatag fvfqsrvrn ataissgasg vssgialdgt fmrfmnyevn aryaitpawt
301 vagsytytag qfnlqtayal skrtdvylqg vyqkvnsdgt glgayingvg
361 gmssekqia vtaglrhrf
```

38

```
  1 tcagaacttg tgacgctgcc cgcgaactgg ttcgccgatg ccgacggcct
 61 gtccctgccg acgcagccg gatcgctcgc gtctgtcgc cgccaccag
121 ctgtatgcg cctgaccgat agagtcggat gcgcttcgac agttgtagt cgcgcgcgt
181 gtacgatccg gttgcactcg cctgacgac gccccagcc gcgtgaact gtgttcgt
241 gtaacacaca cctgccgtct tgaagagcgc cgtcacgct cagagccg cggttgattc
301 gaagttctgg aactgctgg cgttcagtg cggtcagcag agccccgcg cgcagata
361 gaccgtgcag accggttctc cactcgttag ccgccgcga cggcgcg gtcgacg
421 gcgcaacgt tagttgacgc cgcccgcgag ctgcggcagg gatgcgcagg ttcgcgcg
481 gtcgtgtcg cgatcgcgc ccaagcgtta gccgcgtatt gtactgccg
541 ggcccgagt gtccgttgc gtcggtgta ccccgtcca cgtcagacc acttgcagac cgttccagtc
601 cagaagcc gtcgcgttgc tacttgatcg tgtgttcac cggaaacgag gctgcagg cgccaggta
661 cggctcgcg gaacgggtgc gagaacagca gcggcgtttc gtgcgagcc cgtatgcg cgtcgacg
721 gaacggggtg cctggccgac gaatcgtat gcggcagccc cgcagcc caatattcac
781 gtcggccaac gcctgcggc gaacatccg gaaacaccgg caggccgcc cttgattcg
841 gccagcgaac cttccaccg gtcgaagacg ctgcggcg agctgcggt gtcctgcc
901 gtcgaagcca gcagggccc ccggttgacg cctgcgcgaa agtcggagt gccgatcg
961 gcgcagccg acgtccact tgtccgtgta gtgcgcagcg agcgtgtgg cgcgtacag
1021 cgtgacgttg cttgggccga aaaccggcgg ggcataccg gcgcaatgcg cagcgaaat
1081 gatgctgctt tcattactg atatcccga accctgatc ggctcgcg cgatgtccg
1141 gcgcaacgca tgtctgcc gttctgcgc gttcgcgg ccccattccgg gcat
```

13

```
  1 mprngaqkrr thrggptsar pppnqgleisi mkhhiisaaa llafaapvfa qssvtlygvi
 61 degfnytsnv nvngvkseny qlasgfaqgs rwglrgsedl engfdvmngr
121 lqgggrmfgr qafvglshaq ygsltgrqy dsvvdylapl tangnwgll fshpfdndnt
181 dnsfrvmnti kyaspdwngl qvggtysfsn atgfsnnrqy sigaaytlgg lqlaaaylga
241 mnpgktagga iadndanfta drlrifggv nytfgpatvg aqyvytdgkf pvstvylpta
301 tfaglgltat kfqnfeingk yqltpalfig yhtiglmady daagtvkpk
361 nlskrtdvyl qgaykqkvagd ktgtiadggy vvgtqgpsas anqtavraai rhkf
```

```
414   39   83718334  YP_439716   39

1  ttagaagcgg tgacgcagc caaccgctcgc agatcgacgc ttgatcgacg tgtcgaacgg
    61  cgtgctgagg tcccgtgt agatcgacgc ttcgacgaac gctacgaac
   121  agctgtgcg tacacgtgc cagcgcttga tcgccgtcga cagcgcttga cgccaactg
   181  gttccagtgc gcgtttcgc cgtccgctt cgcgtcgtg tacgcgtaag cgcaacctg
   241  accagtgcc ggcgtcagt ttgccagt tgtacttcac gtccttcg tagtgtcgg cacggatggt
   301  cgggcgcgta gcgtagcttg cgtccagt tgtcgagcg cgatgcgc cagagcagc cgccttgcag
   361  tgcgtcgtg cggcgcgatt gcgccgcct tgaagcctg cgtacacgc gtacacgcc tggatgcttgc
   421  gctcgcgttg ttagcttgc agtacgcgg agtacgcgg accgcttc aggccttga actgtacga
   481  agccgcgcg cgtaccgac ggtgtcgc gaatgcgaa ttgtccgag acagtacgt
   541  gcccggaat tgcaggcgg tgcagtcgt gccgcgaac gtcgagtgg tgccgcgaac agtgcaccgc
   601  gacgtgccc ttccgtca gccgtcgtt gccgcgaag gtcgagcg gtcgccaccg
   661  ccagtgccc gtgccgaca gcggcacag gtagtcttgg gtcgccgt actgacgcc
   721  cagcgtgacg gtcgtcagt tgctccacga gccgacaac gcttccaacg tgaacatgcc
   781  gccaccgttg tgaagcggc cgttaacgat cttccgaacg aaacgcttt ggtcagcgcc
   841  cttccaggcg cgccaccagt ccgccaggt acttaccga gccaaaccg gcgcgagacg gtcgttggta
   901  gggccgacc gaccacagg acttaccga gccgtacag cgccgcagg cctggcgc gtcgaacgc
   961  cgtagcgcc cgtcaggcc gcgcagtaca ccgcgactg cgttgcgt gtcgcacgt
  1021  agcgaacgat gcagcaactg ctgcaacaat cagacgcttg ttcat 415   55   83716254  YP_438901   40

1  ttagaacttg tgcgcaggc ccaggcaac gactcgtgc cgccgatgcc
    61  gtacgagccg atcgagcct gtgctgcc gcgtccgct ttgcgtgctg
   121  gtacgcgca gccagataga cgtcagtgc cgacgtac cgagcacgc ttcgacgga
   181  aacctggtg tacttcgt cgaatcgt tcgacttc cgacgactg
   241  cagcagccg gccgactgc cgcgactagc ctcgacagc gacgagcgg cgtagtaac
   301  ggtcagcga atgccaaca gggcccaac cgctgtcca catatgagc gccgatgca
   361  gaactgaac gggccaaaca ccgttgtca tgaacacga gttgttcgga cctcgagca
   421  cgtccgtag ccgtttgca gacgcctg gtcgcctg tccactggc cgcgaagtg
   481  ggagccgtc ccgtgttca gaaccctc tgcctaagc gagccctg ggcctaagc tcgatggtg
   541  gaagtaggcc gcccgaagc gacccgatc gtcgctgta ccgcggcgg ccgccacgt
   601  ctgtccgta ccggcaaac acggccgacg tgtacttag cgtcgaagcc tgttgttgt
   661  gcggcaaac acggccgacg tgtcgaacg ttgtcgatgg tcgcgggag cgtcgagcgc
   721  gttgtgacaa tcaaccgtg gcgcgaacg atccagtg tcagcgacg gtagtaac
   781  tgggcaagc tcgacaagg gttcgagcc acggccagg gtcagcgc gtacttgtgc
   841  gcttgcacg cgaacacgg tccgaaacg ccgcagag cgcgactctg
   901  gttagccgc ttcaagccgt ccgcgaactg cttcaggcg ccgctccgcg tttccatgc
   961  ctcggtgaa cggggcaac ttcccggcct tgcaggcca gcgcatcatc gacgatcaat
  1021  gttgtggcc ctgcctttga ctgcgcctg cgggtcg tttccatgc
  1081  cagcgtgacg gcgagttct tcattgact cctcggcgg cgagcgagc cgtattgtt
  1141  ggtagacga agatagaga actgcatcaa atgcaagaaa tccaaaaaa taaagtgct
  1201  tgcggattg acaacgatga acacgatgga aagctcttt tattacacga ccattcgat
  1261  caaaaggtg acacgatga ctgcccatg gttggttcga gattgtgc gaacaaga
  1321  tcggggaca ctgcccatg ttcaaggct gttgtgca gaacgaaggc ataccgcg cagagcgag
  1381  gtcgggggc gttttcggg cgttcgcg gcaaggcgg tgcatgcaa cgttgccgg
  1441  cgttgcgtg gctcgatgg cgacaggcgc cgcgactctg gtccgacac
```

```
     1  mnktlivaav aasfatvaha qssvtlyggvl dagityqsnv atpsgsgksl wsvgagvdqs
    61  rfgirgsedl gggkaiftl esgfnigngr fnnggmfnr qafvglssny gtvtlgrgyd
   121  atqdylspls atgtwggtyf ahplnndrin tngdvavnnt vkftsanyag lqfggtysfs
   181  nnsqfamra ysagasyrfq glkvgaaysq annaganttg atdpltgfni ggtnaasig
   241  rsrvygagas yayglqgqi lwtqsridnl angaptirad nyeanykyl tpaglgvay
   301  tytnakange sahwnqvgvq advalskrtd vyaqavyqrs sknanasiyn gdlstpfsts
   361  inqtaatvgl rhrf
```

-continued

```
1501 gagcccgca tctttccgcg ccaggtgcgc ggtagatcga gcaggacgtt tgtcggcg
1561 caatacgcgc aa
```

416 58 83720933 YP_442964

15
```
  1 mrvlrpskrp arstahlark dagvvseqsa aferapvaia atatpanvcm hrlccenspk
 61 taphtsnmla satiatgpsa svpgiemvvy vidikrlfia vtflrhfifl dflhlmqcai
121 lqsatnndsl awnssmkkl alstlslall gaagaaqaqs kaifqlengf sityvhgndg
181 kannawqmgs gnlqgarvgl kgtedlggi nsangalgqg smfgrqafv
241 gvqsdtygtl tlgrqydplv divqpvtadn yfgslfatpg dvdmdnslr vmntvkytsp
301 vfagfqfeal ygfsgiagsp gtqtwaaaa aynngpvgig agyfhasnsa plsaagvrtg
361 wggssdaifd gpdnslfmnn gyatakigi aqvgaqyvfg pftfglgysn aqyksdsasa
421 fgstekyntg rgfvtyqats alllglgyliy tkssgdsnak yhqvslgady slskrtdvyl
481 agayhasgt qagggdaqas igsyigggtk sqemvalglr hkf
```

41
```
   1 tcacgcacac gcgtcttcgc cgccgcacgc ggcgcgcgac cagccgcccgc cgagccgcgc
  61 atacagcgtg atgcgttcg ttcgagcgcaa ctgcttcagg cgaatcagtt cctgcccgga
 121 ctcgaaacgtg ccgagccgca ccgcgagcaa ccgcgaactag ttcgcgacag cttgccgcta
 181 gcgccgctcc gcgagccgca gccgctccgg gccgccgccg gtccgagccg tagaccgcct gctgccggc
 241 gagctgcgca tcgatcgat ttttcgtatt cggcgaccgc gagccgctcg gccacttcgc ggaacgcgt
 301 ctgatcgtc tttcgatcgc cggcgaagat gatatgcttg cgccgctgcg cggcgtcgag cgaactcgag
 361 attccgccga ttgccgtccgc ccggcaagcg cggcgagcg agaacgtcg ctcaccgag cgaactcaa
 421 cacgctcgag cctgccgaga agagccccga gaacgccgc gcgcccgcg caggccccg cgatcgcgg
 481 cgtgagccgc atgccgggga gccggcgtcc ggcgatgtc agggcgtcag cgtcggctgc cgtccgccgc
 541 gacagccgc cccgaggcgt acccgagtc ccgcgagttc aggccgtct ggcgcgcagg cggcaggc
 601 ccccgagcg accgagagc tcgccggcga ccgcgagtcg cgcgcggcc gctgcgcgc gctgccgctc
 661 cgccccgaa ttcgatcgc gcagctgcgc gacgagcatc tcgccgccc tgcgccgtgt gcagctcgat
 721 gagccggcc gtccgatcgc gtcccgcccg gccgtgcgg gacgagcatc ctgcgagc cgtaagtcg gccgcgcgc
 781 cgccgtgct gccgtcgcg gttcagcggc ggtcagttg ggtcactcg cctgcgagc gcggccggcg
 841 gtctcagttg tgccgtcgcc cgtcagttg gctcagcgg cgccgccgg tgcgctcgg cggctcgaa
 901 ggaccgact tcggacgcca tcggacgatca ggtcgacgg cgcgcgccg tgcgctcgg cggtccgaa
 961 gtactccgcg agccgccgt ccgacaggct cgacaccgg cttcacgcgg cgcggctcgg ctgcccggg
1021 cgcgctcaag ccgacgctcg cgcgatacag ccgcatacag cggtcctgc cgacccgg gcagcaccgg
1081 gtcgtagagc tgcgtcgct ccgcgagct ccgcgagct cggcgtcg atcgagcgca gccgtccgc
1141 cggccgacg ccgtaaaggc ccgtgcctc ccgtgcctc cgcgatgcg agcgccgca tccgcagatc
1201 gcgattgttc gcgagccgc gtcgatcag catcgctcat ctccgcaca ttgccgcgc tgaagtacgc
1261 gccgcagtcg tcgagggca tcggagcga ccgcatgct ccctgcaca ttgcccgcgc cggctccggt
1321 ggaccgtgct cgggcgtgct cggggcgtgct cgggcgtgct gcggcgcgg gccgcgtc cggctagcg
1381 ccgccgcag ccgcggcga gataattgc cgcatcgcc ggcgacggg ggccgccgg gctcgtagcg
1441 cgccggcag gtcagccg tacgagccgg tcaccgag gccctgccgg ggccgccgg atgcccccag
1501 cccccggc cgccgccgc cgccgaaac cgtgcgacgg gccctgacgg ggaacggctt tccatcatcgt
1561 ttccacttga tctccagtgc ccccgccgcg gccgccggc ccgcgccgc gaccggaac gatgtcgacc
1621 acgcggcgc cgcat
```

16
```
  1 mrprgrhrs aprrrargt gdqvktmmkp larqgqphgs rrpgglrawp aalaalvtg
 61 ctlapryerp aapvpanylp aaagapraas paaagsgard aqpasdargg gnvqemhdvr
121 lddwrayftd palralidaa lannrdlria trlieeargl tlrleeargl ygvaradrlp sidgslgyer
181 trlydpvlre satsslyras vglsafeidl ertlaardat yaltarryaa alaeyfatae aqraarvsli
241 aevasayvre ralvdqlkla qaasalkila gdftaalpad apaldelava gtstaielrt aemlvasara
301 skaalereht iqgaaraffp rialttdigs vsdafsglfs agssvvtfap leqrpdirqa rvspglssdl
361 eqrlvaanan arkhiavaey ektiqtafre vadalaardq idaqlaaqa rltlpifagg vygadaerlr
421 rmranldvad arkhiavaey rstfeesggel irlkqlrltn aitlyralgg gwsraacgge
481 laerrygsgv asyleilldaq
541 daca
```

-continued 417  55  83718989  YP_441238  42
```
   1 atgaagcgaa aacatgtttt gactgcactc gcagtcgcgc tgccgcgcg gggctgcacg
  61 ctccgccgc gctacgagcg tcccgcgagcg tccggccgg gccgtgtccc gcagacggc ccagcggcc
 121 gtctacgacc cgcagccggg gctggccgcc gtcttcgtc tgcagccggc tgcagcggct gatcgagatc
 181 gtcgacatcg gctggacgag acaaccgga tctgccgtg cggctctca ccgcaccgg gtcgcgcgg
 241 gcgctgaaga acacgcgca tcacgcgcc gggccgtgtc ccgacgctcg acggcaccgg cacggcacg
 301 cagtatcgga tcgccgcgc gggcctgttc tgtgtcggta acctgtccgg ccgctatctc gcgaccac
 361 atccagcgca tgtcggcgc tgtccggcgc gtgtgaagtc gaccgttcg gccggtccag gcgacctgaa
 421 aatgcggcg tcgcagcgc tgcgccata cttcgcgcagc gcagggcgc gcaggccgc ggaactccg
 481 gatcaggcgc gcgtcgccga tcagctatctg acgctgcgt cgaccgacga tctgctcag
 541 ctcctgcga gcacgctgaa gacgggccga gctcgatctg acctgctacg gctgcagttc
 601 atccggaga acacgctgaa gacggccgg gctgctgcgg acggcgaga acctgctacg cagacccgg
 661 gacaaccggg ccgcgaacc agcaggcga gcgcgccgc cgcgccgagg acacgtcgt gctgtctg
 721 ctcgcgaacc agcaggcgc agccgctgcc cgacgaactgc tccgcgccc tgcagctcaa tgccgcaaat
 781 ctgatcggcg acatcccggc acacctccgg cgacgactgc cgcgcctcga tgaccgcgc cccgacatc
 841 ctgtgtcgaacg agcaggccg gcgcgcccgc cgcgccgcc ccgcgccgag tgacggccgg gttgccgg
 901 atgcaggccg aggaggccg gcgcgccgc aacccgaaca tttcgcgcc cgacgactcg gttcgccgcg
 961 tccctcccga aaatctcgct caccgcgcgc gcgcgtcgt tccgcgcacc tccggccga gcaagcgc
1021 ctgttccaag ccgcgcacgg cccatccgat cacccgccga tctgccggcg catggagcct
1081 gaggcgcgga agaacatcgc ccagactccg acaggcgcc tttcccgaac gtcggtccgg gttgccgcg
1141 cgcgaactac agaagccgat acgatcagca gaccgcgca gaccgcgca acagcgcgca gcagccgcga
1201 cgcgcacgt acatccagga tgttcgacct gcctcaaag aacggcgtcg acattatct gtcggtgtg
1261 cgtacgatc cggatcgta tccggcacg cggctcaag aaccactga tcagcgcg gctcgcgcg
1321 accggcaga cctgcgatct gtatccgcga cccggccga gctgatcga acgcgggc
1381 tggacgaccg tcgtcgatct gcccggcga tgcgcctgc ggacaccga aggcgccag gcctgcgcg
1441 gagacccgcc gccggccgga cccgccgga tccgctcg gactaccga gccgggccgg gcgcgggcg
1501 gctcggccgt gcgcgtcggc ggcgtccggt gcggcccgca gcgggcccgg ggcgcgctga
```

```
   1 mkrkhaltal avallaagct lapryerpaa pvsgafptdg vyaaqpgaaa garsangqaa
  61 vdigwreffv dprlqrliei alkmnrdlrv svlnveasra qyritraglf ptldgtgtgt
 121 iqtpagvsv tgplisrty ngvsaswel dlfgrvqslk dqalaqyfat aqarkaaeis
 181 lvasvadqyl tllstddilq itentlktar asyditklqf dngtgseldl rqqtvveta
 241 langqaqara raqvnalvl igepipddi paglpinaqn ffpkisltga fgtaspligg lfkaqtaaws sdlitrrpdi fapialpif
 301 mqaeetlraa nanigaataa ffpkisltga ffpkisltga fgtaspligg lfkaqtaaws sdlitrrpdi fapialpif
 361 eggqnianld lahvqkriei anyekaiqsa frevsdqlaa rgtydqqiaa lernehaqri lgggwierag
 421 rydlsdlryk ngvdsylsvl taqtdlysaq qqlisarlar wtnlvdlyra lgggwierag
 481 etprpadapv dygkaaapap asasasaapa aaasasaapa
```

418  19  83717287  YP_440214  43
```
   1 gtgcaagcg aagatcgca agattccggt cgcgagccgt taaataggaa tgatttcag
  61 gccgatttcc aatcccggct tttgatgcg gcgaccgt tccaccttcc ggatcccaa
 121 cggatccgcc cttggctttt cgcaagacga cgtttatcgt caggaactc aagccccac
 181 agtcacaag gaacgaacat gcaagtgca agaaagtca tgaatatct gaacgggac gtacaagcac
 241 ttgaaaaacg agcgaccg gatcaatcaa gatcaacgaa tattcctgc atgcggcga aatgaagcat
 301 tgggtctcg agaaaactcg cgtgtctcatg tacgacgaa ctcgacgcc tgccaacct gcagatctg
 361 gcagactggc tcgatcgaacg cgtgttcatg gaaatctgaa gaatcgcga gaatccgaa
 421 cacagtgtc tcatcgcgcga gaaacccgca atcgcgtatt gcgaatcggt gcgctgcga
 481 caggctccgc aggcgacgtg caggaaagcg gcgaccacgg atcgcgtatt gcgaatcgg gcgactggtc
 541 gtctcgcgcg aaatcttcga caggaactc gacaccgtc ggcattcaga aactatcagca gtcgatgatg
 601 gaaacgcaaa tcgacctgat cgacctgat
 661 ggtcgccgg agtaa
```

| 419 | 8.5 | 83718020 | YP_440216 |

```
  1 masedrqdsg rervnrndfq agfqsqlfda anpfhlsdie rirpwlfane rlsfrnsph
 61 tsqgtnmqgd kkvleylhaq lkneltainq yflharmykh wglekglgkhe ydesigemkh
121 adwllervfm ldglpnlqdl hklligeete eilkcdlkle qvsqatckea iaycesvrdy
181 vsreifekil ddteehidwl etqidligkv giqnyqqsmm gspe
```

| | | | 44 |

```
  1 atgatcgtct ggctgtgcaa gtccgttcc gatcgaaga ttcgcgcatc cctcgcggaa
 61 ggctgaaca ccttcgaaga actccagttc gaccacctg tgccacctg ctgcggcaag
121 tgcgaggaaa ccgtcgcg gatcatggcg gaacacgggg tttgtgcgag ccgctgcggt
181 gtcgagccc cgcggccgt gccggtcccc gtcacgttct acgaacgcaa gggcgcctga
```

| | | | 19 |

```
  1 mivcvcksvs drkiraslae gvntfeelqf elgvatccgk ceetvreima eqgvcasrcg
 61 veppaavpvp vtfyerkaa
```

| 420 | 36 | 83718178 | YP_439311 |

```
  1 gtgggcgca tcgggtaccg aatttcctgg cgggcgcatc gcgccgcatc gagaggcaag
 61 cgcatgctga cgatcctgt caaacgactg tgcccctg atcccgggcg cgtcgcgtc
121 gggcccgaag tgtccactg ccgccactg ctcgccgcg gacgctcgg cctgacaag
181 gggcccgag ccgacacgcg cgcagttcgc gacggatcg agccttcat gccgacgtc
241 ccgtcgccg ccaagcggcc tcgtcgacc agcgtcttcg gatgcgaat cggcatcgcg
301 tcgctgacga tcgtcagat cgccgttctg ggcccggca acgctctcg ggcccggca
361 tcggcccgtgt tgccaaccg ctgccggcca cgcgtccgga tgactcggc ggtgatccgg
421 atctccgttt cgcgcgttcg gccggtctgc ctgctccgga agtgttctc ggtgaagtc
481 ggctgtcgc cgcctcgtgc ccggccgtgc cgctccacg ccgttcgacg catccgaggtg
541 ctcgggtccg ccggatcgg gacgggctg tggaagagct acgtgctgcg gtccgagtg
601 ctgaacgagg atttccgtgg accccgccgc caccccgcgc gcgaagggcg tgccgagcc
661 ctcaagcact gctcgcgcaa cgcgcgatt cggcgtcg cgatgatgg gctgcagtc
721 ggcttcctgc tcgccggtc tcggccgtc gactacgtgt tcaactggcc gggctcggc
781 cgcctctgc tcgatctgc tgatcctgg gactacctg tgatccagge gatctgtgc
841 ctgtctcgc tgcaatcat ctgatcaat ctgaccgtgt actcgtgta cgcggtcatc
901 aaccgacga tccgttccaa gtga
```

| | | | 20 |

```
  1 mgrigyrrra arsraasrgk rmlnflvkrl fgllptlacv avlvflfvhl lpgdparlaa
 61 gpeaddatva lvradlgldk plpaqfasff ariaqqdfgv strskrpvat eigerfmptl
121 sltvvsmawa tlfgmaigia savwrnwpd rvgmtlavsg lsfpafalgm llmevfsvkl
181 gwlpvvpdgs wksyvlpslt pvtmmglqf gfllggsivv rftrasfiev lnedfvrtar akgyrepmvv
241 lkhclrnami pvvtvmglqf gfllggsivv eavfnwpglg rllvdavtmr dypviqaivl
301 lfslefilin ltvdvlyavi nptirfk
```

| 421 | 42 | 83718226 | YP_439914 |

```
  1 tcagaagcga tgatcagac cgacgccgac gccccactgg ctggccgacg acgacggcga
 61 cgtttccggtc tcgacccga tcgacactgc cgcgtaaag ccgtgatg atcttgcccg ccgagcgt
121 cttccgttc acagccgtca actggtgta ctgccgcgcg ctcgcgatgc cgtcgattg
181 gtaatactgc gacagcgtca ccgtacccgt agcgccccac tgaagcccac gcttcgaatg
241 cgtcaccgcg cacaccgcca cgtaccgtgt ggtgtgtcgg gatgtccgac accgcgagt
301 aatgtcgag acgttcgagt acgacaccga gatgtccac gcggacgaga actggtagcc
361 ggccctgacc gccacgcgt gctgcgcctg cgttcgacgt cgcggtccttg tgatccgcga
421 cacggcgtc tcgcggccgc ctggaattc gtggacgat cgccgatg cgtcccgt
481 cgacgtgag tgtcccacg gtgagccgcg gttcccgacg cccgcggac cgtcatgta
541 ctggatccc ataccccg ccaacagcg agcgtagaa cttcggcgac atgtagaaga gcgaacgt
601 atacacgcg cgtagtcac cgaactgta agcgtagaa gcgtatgagc atgtagaca gcgagttgtt
661 cgtcggtag ctggtcccga ctggttcga ccgacaacga gcgaccccgag tgcgccgcca agtaacggt
721 gagccaggtc gtcgggcgt gtacggcgtg acgcgacgt caggcgtag atgacggcc
781 ggccgtcagc gtaccgtacg tcggattggt gtaccccgac cacgccgcc gcgtgaagat
```

```
                       -continued
    901 gcgccccgcg aactgcgacg tgccgttggc cgtgctgaaa cccgattcga
    961 cgccttcgag ccgccgccga ggtccctcgc gcccctcagg ccgaagcggc
   1021 cacgcccgtc gacatcttca cgccgagcg gcgcccgtc gttgagccga
   1081 gctgtctga tacccgatcc cgtatcgac gataccgtaa agcgacacgc
   1141 gtgccggtg gcgacagccg ccaatccgg ggccgtcatc ggcgaccgctg
   1201 cat 21
      1 mkkrtavamt aaglaavata haqssvtlyg ivdngiayqs sstslgsttg grsavkmstg
     61 vwagsrfglk geedlggsk aifqlesgfs tangtsqfag giftrqawyg ltnptygtlt
    121 agrgtayyt llspyspttw ltgyfgahpg didsldtsyr tnnslvymsp kfygftfggs
    181 yafggqpgsv nagstwsagi qymngplgia aafqrvnnst sgggdwgans ttsnggaqta
    241 vsaimgykt aqaqqrvavt agyqfssawd isvsynvqy ipgvnsafrn taifntagav
    301 lhfkpsaqwd fagyaytra tqsngitsaa qyhqftlsqy yslskrtgly aveayqrang
    361 ktlaggkid atasigdgfn tepssrsgv gvgvlihrf 47
      1 ttgcacacac aagtaattca gacagataaa tgtaaggaaa tccttccga gtccattatt
     61 cattccgagt caggaaacac agccgccgctc gggatgcg acctccccgt tgtccgcttg ccgaaccgcc
    121 acgccgtcg cgatccgcgt cgtcgccgct gtcgagccg ttcgagcg cgaactattt cggcatcaag
    181 agcgacaagg cgatccgcgc cgactgcgct cgcgacagcg aaccagtccg cgcagccct gcgacccagg
    241 ggcgggccgt ggcgcctcgt cgccgtcga agcaattccg acgatcgcgc gcgagccgc actcccaag
    301 ctgatcgacg aggcgctcga cgtacatcga atcgtcgcgc acgtcgcgc tgcgaaggc ggatcgcgc
    361 aagcatcgt cgctacatcga gtattcgag aacgccctcg tcccgcgcc ggacgcgaag
    421 tactcgtgga gcgagaacca cgccgagact cctgtgggc cctgggc
    481 cagtgtaca gcgagaacca gcgccctcaa tggcgcctg tgcgagtcg aggcgccga agcgacatg
    541 aagaaccgcg cgcgtgagct cgccgacgct ggggccgcct gtcgagtcg cgcgcaacca gtccgcgcag
    601 cagcaggcgc cgtgacgcg tgcgacat cgcgacgc cgcgagccga gagatccga ggtccgcaag
    661 ttgtacgcgc gcgactgcgc gccgagcgg gcgtacacc gcgaagcg tcgagcgca gaccgcctc
    721 atcaccgatcg gccagacatcg tgtcggtcgg cgacgactcg tccgagcgct acgcgacgat cggcttcgac
    781 ggcaacatcg cgacgagcga cgcgcggct gtccgcgctg gtcctcgcag ggcgaagac cacgaacgtc
    841 cgtatcagc gcgcccggct gcccggcgcg gtccggcaag ggcgaaggcc gattgcccg gattccgta
    901 ccggtcgtga gcgactcgt cgaagcgcg gcgacaaggc ctgcaagtcg gcgacgaaga aggcgacgtg
    961 tcgccgacg aggagcgca gcgcccgatcg cttcccgac atcaattcttg cggcttcgac
   1021 aaggaaagcga aggccgaagt gggccccgc ctgaaactc gcgagccgc ctgcgccgc aactgaaagg ccgtaccgg
   1081 gcgttccggc gggccggccct cctgaactc gcgaagccgc ctgcgccgc cagaccagcc tgagcacctg gaacgacgtc
   1141 atccatccgc cgatcctcga tgtcggtcgc gaactacaac cagaccgtcg tggcgcgct gaaccgac
   1201 gacttcgatc tgtcgggtcg ccgtccgcg gaactacaac acagaccgtcg gacacccgaa tggctcgatc
   1261 gcgacgacga tccgacgat cgacccgatc gacaccttg gacagcgat tggccgcga cagcgccgcg
   1321 ctcgatgctg cgacgcgcg gtacgacgcg gcggtgatcc gctacaaggc gctcaaaggc gggcctgtcg
   1381 ccgcagctgc agtgctgaa cgcggacag cgcgagcag aaccgctcg cgccgagca gaccgtgacg
   1441 aacctgaaga tgcgccgcg cgatctgcag atcggcctcg tgaaggcgct cggaggcggc
   1501 ttcgacgcga cccgcaccga cgtcgacacg gtcgacacgg cagtgcgcgg ggccgcggca
   1561 cccgcggc acggtcgaa ctga 22
      1 mpqqviqtdk ckeilaysii hsesgntamk tfplsacrta tavavavlal agcanyfgik
     61 sdkalapatq fesaqslpaq ggrwpsldwa nqfgdpqlpk lideaaegnp tiaqagaria
    121 kassyiessr stllpkdadk ysvwtrelyss nalvpppfgg qwysennala sasweldlwg
    181 knrarlnaav sqekaaaadm gqarvtlats gniatsgstl sdldgqitnv vartynglaq lyalrdiaer eisnrgtvgk
    241 itdgrvgagl dtnverqtal lpdnlpadlv srrpdlvaar wqveaamhdv keakaeffpd inlaaglgfd
    301 pvlspggvva lpdnlpadlv srrpdlvaar wqveaamhdv keakaeffpd inlaaglgfd
    361 afgwgrflnf asrgaqfgpa ihlpifdqga lraqlkqrya aviyrkagls dfdlsvanyn qtlvsalndv
    421 atqvasirsl dtqmgdaqra ldastrayel aviyrkagls pqlqvinads nrlaaeqtvt
    481 nlkmrrrdlq iglvkalggg fdatgtrlat papavaaaaa parhasn
```

| 423 | 85 | 83718695 | YP_442137 | 48 |

```
   1 atgtcccatg aacttgccgc gcacgtcgcg cgcagtcggg tcgggatcgc
  61 gcgtctcgct ggccgccgct cccgagtcgt gcacgccgtc acgacgggcg cccgtcc tgccgattca
 121 acgtccgcgc ccgctgcagc tccgggaaa cccctggata cgtcagggtg
 181 accggcgagc gcccgcatt ccgtccgac accccgcg tgtcgaggc gctcaccgg
 241 gagcgcagtc atcgcacgt gccgcgcta caacgtgacg cgctcaagta cggccgaac
 301 ctgatggtgc gcgcggcta tatccgcgat cgaactccg tgtccgccg cccgattc
 361 aacgagttgc agagccgcg cggaactgtt tacgccggac gcatcctcct gtcgaatctg
 421 ctcggctcca gtactcgat tccgccgt tggtcgctga tccagccga cgaatccgcg
 481 cgtcgacg tgtgtacgg ccgttctcc gcgctctacc cgggcaatgc cggggctcg
 541 acctgcaga tcacgacgcg cagcggat cggtcgagg cgtcggtc gacagtcgg
 601 ttcacgcagc gctatcgga cgctacggg cgtcggggg gttcggcgg caatcaccag
 661 accggcgcg tcaccgacg ccggggcg ctgcgggc tctcgagac cgaccgctc
 721 gagaacgaca gccaacgcat gcaatacgcg agccgaatg gcaccttcga tccggctc
 781 ggcgagcg tgccggttgac ggcgcgtt tccgagag cgcaacgg ccgggctcgg
 841 acgatcgtg gccgcagac gatcgagcgc acggagcagc tcggcaactg gctgcgttc
 901 ggctatgcgt tcaccgacca cgtcgatcgg acggttcag tggccactg gagagatcac
 961 taccggcagc acggcgacac gttcctcgg gacgtgcga gcaacccgt acagggcgg
 1021 aacgtgcgt tcggcgggcg cagtcacacg gtacgctaa cgttctcgc gccagagacc
 1081 ggcaccagg agaactggct gtactgcc cgctacgag cgcgcctcgc atcaggctgg
 1141 aagctgtcgt cgaccgctcg cgcagccgc agtgtcgg acgtgtcc cagccgtcc
 1201 ggcggccga ccggcgcgtg cgaggcggg ccgcccga tcgcccga cgccttctcg
 1261 ggctgcgcca cgtcgatt cgtattcctg gcgagcgag tgccggca ccccttcg
 1321 ttcggctatc acttcgacac ttattcctg ctaacaca gctacaacgc gggactgg
 1381 caaaacgcc tgccgacgga gcttgaaca cgttatcgc ccatcgca gacaggg
 1441 ctgtacgcgc aagacgtg ggtttcgc gcgtttcgg ctctgacgcct ccggctgcgc
 1501 taccaacgat gggatgcata cggcgccag ctcgcaaac gcaacccgg gtcggctac
 1561 aactgtcgt gcgaccag gtcgccgcg ctcgccgcg aagccccgc gccaatggca gcaacgac
 1621 gcatgcagg tcccggtgtc caacaaggg gtcgccgatc gtcaacaca accccaact gaaccggaa
 1681 ttccaggca cgatctcgga actgggact cacgccgcga cgcaacctcg gctccggct cgttcggcgt
 1741 aaggcgatcg acgtgtttcc gaactgaatt tgccgggaa accccgccga atctacagcc agacgacgt cgggcgct
 1801 agtcgttcc cgaacatttc agagcgatcc gagctcgac cgtcgggg tgcggggcct cgaactcgcg
 1861 tcgactaca cgaacaggga gatcaagggg cagttcgttt gggtcgtttt acctcagtt ggctaccgg
 1921 tttccagggg gtccgtatc acgcgggca gatcaaggg gcagttcgttt acctcaagg ggctaccgg
 1981 aactgcgaga ggcgcagg cgtcgccga tgggcgcgaa tgcgggaat gcgccgat gcggcggcgg tgccccggg
 2041 atccacgga tgccggaa ctttgccga gggcggcag tacaacgcgc tacgacgct ctgatgacg
 2101 agcgtccgcg gtcctatc accgcgatcg cagttcgttt ggggcgcag acctcaagg cgactgaac
 2161 ccgaacgtgt acgagcggc cagtcgttgt gggtcgttt ggctcgtcg cagttgtcc cgctaccgg
 2221 ttcgatccgc actgtccgc gctcgtccgc gtcgttcgg atcgaacg tgaccgatcg cgctactac
 2281 gtgtttcac cttatccagg                                                        gctgtga
```

| 23 |

```
   1 mshelaahva rtrlaaacva afawpaahav ttgaavpads tsaaaaetta sgktldivrv
  61 taqrpafasd tpgvveltri tedalkyapn lmvrryigd rnsvfagrdf
 121 nelqsarglv yadgilsnl lgssysypprr wsliqpddia rvdvlygpfs alypgnaigs
 181 tvqittrkpd rleasystqf ftqryrdgyg fadsfggnhq tarvadrvgr fwyalsldrl
 241 endsqpmqya spngtfdprl gasvpvtgav sdigpngrpr tivgaqtier teqinetlrf
 301 gyaftdhvda tvtlghwenh yrqhgdtflr daagnpvygg vsrdvlrsas nvsfggrsyt vsptafapqt
 361 gdqenwlygl gldarlasgw klsatasaye fgyhfdtyfl rnatyntadw gaptgawdgg pgtvfhgdgt
 421 gwrtvdlrae spdvrghrfs fgyhfdtyfl yerwdaysgq lgnanatlgy qnavpttlan ryrgntrtqa
 481 lyaqdawrfa pgwlatlglr yerwdayggq lgnanatlgy agrgatalsp klalewptd
 541 awrrlsfat gtrfptvael fqtisnnai vnmnpnlqpe kaidwdftae rdvfgvvrt
 601 svfgsdlrns iysqttvaga stytnisnvd rvrvrgvela syrfgehwmt ldvdanvsat
 661 naqtladaan phvygarwpr iprmranlla syrfgehwmt svgvrysgrq ynaldnsdvn
 721 pnvyggtssf avvdlkayrr fdrhwlasfg idnvtdrryy vfhpypgrtf ygelkwsl
```

424  78  83717289  YP_438727  49

```
   1 ttgatacgtt atatcgttc gttgtcggcg cgcgattcgg cgccgattcg cccgcgattc cgcccaccccc
  61 gagaacaccg caccgattac cgtgctcgc cggccgagcc ccggcgaacg gtatccgccc gcttccgcc
 121 cgcaggccgc atccctttgc gttgctctc cgccgagcc ttgccacgg cgagacggc
 181 gagcagccg gccccgtc gagccgccg atcgggctc agtgccgc cgtgccgc gatcttcgtg
 241 acgcgagcc cgctcgcgc tgccgcgcg cgattcgtc ggcgctgc tgaacgctt gccgcgtg
 301 gcgttgacgc tgccgtgc cgtgcgg cgccggca tcccggggat ggacggcgt
 361 tcgacgacga cctgcagaa tttgcagaa cggcagcg gcatacgacg catccgcgt gtcgacgat
 421 cgcatccgcg tttgcagaa cgcaggaccc cgcaggcgcg gcatacgacg catccgcgt gtcgacgat
 481 cacgggtgc cgcaggctgc gctgagcgtc gctgagcgt gctgagcgt agatcgtgcg cggccgggc
 541 gcgtgctgt acggcggcca tgtcggcgg tgtcggcgg acacgatcg caaccggatt
 601 ccgcgcgaag cggtcacggg cgtcacggg tgtcggaa gcgctcacg cgagctacgg cggcgaac
 661 aacgcggcg cggggcggcg gcgtggaa gcgcggaac gcgcgttcgc gtccatctc
 721 gacgttcg gccgcgagac cgccgagtg cgcataccg gctatcgca ctcggcgc
 781 cagccgcgc gacgacgca ggacggcga gagccggag gcaagctgcc gaacagcgac
 841 ggccgccgtt acggccgcg gcgcggggc tcgtacagt gggccgacg ctacgtcgc
 901 gcgtcgtaca acggccgcga atcgaactca gctcgtacg cgcaaaccgca tgccgggctg
 961 cggatccggc aggaagccct cgcgatcgc tcggaggcgc gcaatctgcc cggccgttc
1021 tcgcagctga aattcgactt cggctacacg aactatctgc accggaaat cggagacggc
1081 gtgaccggca cgacgttcg caaccacgg tacggagcgc gtcggaggc gcgccaccgc
1141 aagctccgcg cgtcgaagg cgccgagcgc gtcggagcgc gccagaacac gttttccgcg
1201 cttgccgcg aggcctccgc gccgacgga tgcactgaag ctgccgccg gctcggat cgagcaggc
1261 gaggaatggc agcgacccga cggggacgaa agtgttggcg taccggcgcg gtgcacgtg
1321 cggttccacc cggagcgga cgcgcggaa cgccgcgcg gcccgccgc gcgggcgctg
1381 aatcgccca gctacacga cgtacacga gggcgcgca acgttctacg acgtcgcg
1441 ggcaccgtgt cgtacacga cgggcaata ctgatcggc gcgccggatg cgcaagcag cgacgtccg
1501 cacggccgcga cggcgccga tcgcggacgc cggccgcga tacgacaccg gcaggcgaa gctcggacga
1561 tcgaccatcg tcgcgctacg cctgccgaaa cctgccgcaa ttgcggctcg gcggccgttc
1621 tacagccggct tgcggaacta cgcacccga tacgaccacg cgtgggcgcg tcgccgcgaa
1681 cgcgtcggcc ctcgcgcgcc tgcagcagt acgtcacgc tgcagccagt tgcagaagcg gcgcagaggg
1741 cgccggagt ctcacgcgt gggcccgac tacaccatg cgccacag gtacacggcg
1801 catgcatcg atctggagct gggcgctgc gcgcggtgc cgcgccatt cggccacgt
1861 gacgcgctgc cggggatgc gctcaccgat cgcgggcag cggccgatg gccgaaaac
1921 ccggttcggcg cgccgcgca cgctcaccat cggccgcgt agcatccgt gccgaaaac
1981 gatctggcga cgacggcga cgaccctcgc gtaccgcgc gcgacaacc tgacccgc gtccgcgtc
2041 ggcgacggcga actgtcgcg caacatcgcg cgaccgcgcg ggcagccgc gacgatccgc
2101 tatcgagct cagtctgtcg gcgcaccgg gcgagccgc gcgcgaccgc gcgctcggc
2161 atgccacga cgttctga
```

24

```
  1 miryivslsa rdsardsvhp entapitamd hhriapsa rrlhplsll aaslahgetg
 61 epagrpssap patalapifv tanplgasal tsptaslsgd altlrradsl gdminglpgv
121 stttyqplvg rplirqmdqd rirllqngva aydasslsyd havpqdplsv erveivrgpa
181 allygnavg qvvntidnri preavtgytg aldasyggan naragaalve ggngrfafhl
241 dafretdel ripgyahsar qrardqedas epygklpnsd grrygaagg sqlkfdfgyt sytwadgyvg
301 asysgyesny gsvaetdarl rmqervaia kigpfegalg vqvgntfsa searnlrgpf nylhreiedq
361 vtgttfrnhg yearveathr klgpfegalg vqvgntfsa searnlrgpf nylhreiedq
421 eewqatdalk lsagariehv rldpsangdd kfgvarsrdf nagsysagal yqlapawsva
481 gnvsyterap tfyelyangp hgatgylig lpdarkekav stdlairyan gpnrgsvgvf
541 ysrimrylae ydcqrlvdde gapvapqgde tlreavyrgv raefygvele gkwrafekrg
601 hridelgad ytharnadtg eplpriaplr atlaadygyg pfgaraqlth awqhrvpen
661 dlatcdgytsl gvvltykfrv gatnwlaylr gdnltnqdir yasswrmia pqggrsvtvg
721 mrtf
```

-continued

| ID | MW | Protein GI# | Protein Locus# | SEQ ID NO: |
|----|----|----|----|----|
| 425 | 43 | 83720836 | YP_441236 | 50 |

```
  1 atgcgcgtcg aacgggttcc ataccgctta atcaatgtcg cgagggctgc cgttttctg
 61 gccgcgtcg gaaaaaaga atccggcccg cccctcaaa cgccgaagt cggcgtcgtc
121 accgtccagc cgcaagccgt cgcgcgccc tccgaattgc cggccgcaa gagccgtat
181 ctggtcgcgc aggtcgcgcc gcggtggac ccagcctg ggcatcgtgt tgcgccgaa
241 ggcagcgacg gtcaaggccg gcgcggaggc gacgctcgg cgcctcctg ggatccggga
301 cagtgaaca gcgcgaaggc gacgtccgg tgtcagggaa cggtcagaa gcaggactac
361 gacaacgcgg tgcgctcaa tggccacaca agggcaggcg gccgcgaacg tggccgccg
421 gtcgacgcg cgcagactaa cctcggctat gccggggcg tctccgcagc cacggccgc
481 gtcgcagcg gcagcgctca cgcagggcag tacgtcgcag gaccaggc ggccgcagg
541 gtcggcatct cgaagccatg agcagctcg gcgtctcgca gtgcgacgtc gtccagggc
601 tcgaccgtcc agcgcggact cccgttctga gccagagccg cggacctca gggcggggcc
661 ctgaagcgcc gccagaccca ccagaagggcc gtcaagaacg gcgggccca gctcagttc
721 aagtcacgc tgatccccga gacgccaa gcgtactcgg atctgccgat cttccaac
781 agcagcgcg tgtgctgcg gggcatgtc gtgccggcg tgcacgggc ttccggcaa gggcgtcaac
841 aagcagcgcg tcccgctccc ggcaagcgg gtcaacacgg atccgaagg ccaggggtc
901 gacaacgccg tcccgacgt gggtcagctc gtcaatcggc tgctcacgag gagcggcacg
961 gcgatgatcg tcacgcgca ggcaatggg gagcacgc ctgcagggcg gatcgccag
1021 cagggccag actgggtcgt ggtgccgcc gcaatgaac gtgaagacg atgacgccg
1081 ggcatcgaca agtgcgccc cgggcggg gggcatgacc gcccggcca atgccggcc
1141 gcggcgtccg cgccgacccg tgcgcaggcg gcccaggcca gggcggcg gggcggggc
1201 gcgaacgcgg ccgcatcgg ccgcatcgga tgccgcgctg tcgagccgtc gagcgcgaaa
1261 taa
```

```
  1 mrvervpyrl itvataavfl aacgkkesap ppqtpevgvv tvqpqavpvv selpgrtsay
 61 lvqvrarvd gvilrrefte gsdvkaggrl ykidpapyia qinsakatla kaganlatqn
121 alvarykvlv aanayskqdy dnavatggaa avaagkaa vdtaqinlgy tdvspitgr
181 vgisqvtpga yvqasqatlm stvqqldqpvy vdltqssldg lklrqdiqsg riktegppaa
241 kvtlledgk aysepgklqf sdtvdqttg svtiralfpn kqrvllpgmf vrarieegvn
301 dnaflvpqig vtrdpkgqav amivdgkkv eprvltsgt qqwwvegg lqagdrviv
361 gidkvrpgmt vktaeaqlpa aasgasgaap aggspaqaaa asaaassap ssaaaassak
```

| ID | MW | Protein GI# | Protein Locus# | SEQ ID NO: |
|----|----|----|----|----|
| 501 | 81 | 53719389 | YP_108375 | 76 |

BpK96243-500

```
Sequence
  1 ttaccagttg tattcgcgg tcgcgatcac ggtcgcgtg ttgccgtaca tgcacaccgc
 61 atcccagctg cgtcagacag cgtgaacag ttcgcgcgg tgagcgcgaa
121 acgccagttg cgcagtcgt agtgcagcc cgcgtgaac agcgtcgag tcggcacgt
181 gagccgattg tcggcccgcg acgcccggcc gcctcatgg cgcacgaccg cgccgacgcc
241 gaagcccgtg agcgcgaggc tgcccacct cgcacagccgg tcgttgcccc cgatctgcc
301 cggccgacg acgcctgttt gccactcga ggttcttt
361 cacgcctga tagacgtac agcccgcggc agcccactcg cgcgacaggt tgcccaccgc
421 gtccagctcg ttgctcatgc agcgtcgat ctggtgacc ccgtagacg tgtccgtcgg
481 gtcggtcga tgttcaggt ctgccgaccc gctcaaggtc caggttaccg cccccttggt
541 catcaggttc ttgccgcgg agctccgccg cgatgatc tgcatccggt ggcctggt
601 cggctcgcg agccgccgc gccgatt cggaatcgg gcctcctg cgaactgcc acgacgtcag
661 atagctgaga tacgccgtg tcgttcgcg gccgatag gtgagccca gtgagcggct
721 gaacgcgtg cgttctgcc tgcgtctcct tcggtccgc ctacggcgc atgtcgtct gcgactgcgt
781 cgtcctcgga gtcagcagt gcgcactga cacccagcgg tctgcggcg tgagttcctt
841 cacgtacagg ccgaatgct tcagcagcg gcgagctgcg tgtcgccggt acgggtcctt
901 cccgtcgaag atgtcgaacg gaatcgatt tatcccgcaa gtagtgcga tgtagcggtg
961 ccctccccg cgcacattcgc agcccattcgc agcggcgcg cctcggcgc acgggctcag
1021 cagcgtcgc gaaagcggc cgttcgtgt gcctgttga tctgccgc acgagctgga cgatcgtcga
```

```
                -continued
1081  gcggctgtag ttgaactgga acaggcccgc gtaggcgtcc atcgtcgcca tcgtcggtc
1141  tgcccgtcg agccgccgc cgtagacgga cgtccgtcg agcgacaggt gcaccagcg
1201  cacctgttgc cgcagcggtt caacctgat tcgaactgat agccgagcga
1261  ccactgcttc ttgcggtaat ggtcaagtt cgcatccggc gtgtacagat cgtccgagat
1321  cgtccgttc ggattcgca gcacagtgcc gcgcacggc ggtgagcgcg aggaagttgc tcgacgtgtc
1381  gcccagtcc tgcaggtacg tcgcggcgag gtgagcgac gtgtccgcgt tcgccgtgcc
1441  tttgagcgac ggccgaacg acacgccgtg tccgatcgg cagccgaagc ggcccgtcc tcgccgttgc
1501  gtccgggcc acgcagcga tccgagcgga cagccgcga tcctcgcga tcgtcgcc
1561  gatgtcgaac atcagctgct tgcgccgta gttgccgacc tgcacgccga gtcgcggat
1621  gcgctcgcc ttcgcggct tgtctcgcac gtcgacgatc gccgcgggat cgcctgcc
1681  gtacagcacc gacagcggtt cgcagcagc cacctggcga ggcgatgctg tcgatcatgt acggatcgac
1741  ggccagtcg gacagggtta tcgtgttcgg cacctggcga cgtcgacga acaggtcgg
1801  cgtgaagccg cgcagccgcg cgtaccagtc cgaaccggtg tccgacccgt agtccgagaa
1861  gcccgaatg tagccgaacg cctgattgat gtccgatcg ccccgcct cgatctgc
1921  ccggtgacg acgttgatcg tctgtgaat ctcgatgatc ggcgatccg tttcgtgcc
1981  cgtcatgctg cgccgccga caggccgca gctgcgcgc ggcgatcgg ctccgacac
2041  cgagatcgcg ggcaacgtgc gcccccgct cgccgcctg ggtgtctgcc ttcgctcgc cgccggctg
2101  ccgcgcgtcc ggccgcacg gcgccgcca tgcctgcca tgaccccgg cccgccgta
2161  gaaccgcacg cggccgcga tcgcacgcga gcgacgctg gttgccact ccatcttccg
2221  ttgctccaag ttgcaaagcg gccgcgaggg cgccaccttc atcaa

51

1    mmkvrpsrpl cnleqrkmew atstrvraia agvafyaaaa ghaqaqaap gadarqppge
 61   akadtaaggt lpaisvsgaa erdasvglva rrsmtgtktd tpieipqti nvvtaqqiea
121   tgatdinqaf ryipgfssyg sdnrsdwyaa lrgftptvfv dglqvpntin lsswrvdpym
181   idsiavlrgp tsvlyggqdp gaivdvqskl angerirelg vqvgnyarkq lmfdigdtig
241   kdgtlsyriv gvgrdgnaqt gpladrvsf apslkwqpna dtsitlaaty lqdwgdtssn
301   flpsrgtvlp npngtisdal ytadanfdhy rkkqwslgyq fehklnpvwt lrqnvrwmhl
361   slddasvygg glddadptma tmtryaglfq fnysrfdvdn qaqakfttgp lshtllfgfd
421   ynrqtttdse wlakgpslnl yrpvytpips difsgpnayp rtdtkttlna fglyvqdqik
481   wrrwvltlgg rqdwtrtsqd dianaasfrq ndhafsgrvg ltylgdygla pylsystsfn
541   pqiglklagg glatptkgrq ieaglrwqpp gknlmlnaav yqingtnvam smpdptsst
601   fvqvgevrsr gvelsavgnl srelsvlaay vyqdvknvra ndntlnkwpv dvpprqias
661   lwadwtwrtg plgfgvgca vrymsaaaga adnsltvpsy tlfdaalhye lrnwrfalna
721   tnlfnrryva gcqsdavcmy gnqrtviata kynw 77 53721329 YP_110314

502  55

1    atgaacaaga ccaacatcaa cgaacgcatc cgaacgcgtcg gcggcgagc
 61   gggttgctcg tcggctgct ccgcgacgt tcgccgtg ccgactaccg cggcccgat
121   gtccgacgc ccgcggcgtt caaggaacgc ggcgacgtcg cgcggcgtcg gcagccggc
181   acgtgcaagg cggtccgcgg cgctcgatgc gctcgaacgg ggcgcatccg cggatggtg gccgtattc
241   gggatccgg gccgcgcgcg gtcgagcgac gcgcgaaacg caggcgcttg cggatccgcg gaacctgaag
301   gccgcgcgg ggctcgcgag ccggccggtc gccgaccaccg ggcgccgtc ctccgaag
361   ttccccaag tgggcgtggg agaaacg gcttccgggcg cccgacgaac ggctcgtcg ggccgcag
421   ttccagccgc aggaccgcgt tccagccgt gcgacgctt ggcgaagcg ggccgcgac
481   tcgtacgaga gcccgacgag gccggccga cggccgccgtc cgttcgaacg cgttcgaagc cgacgcgg
541   gaagccgaga cgacacgtg gccagccagg ccggcgcagg tccgaccagg atctgtaccg gcgacggtc
601   cagaactact tcgagctgtg cggctcgat caagccggct ccgacccgg agatcagc
661   gggcgtgcg aggaggcgct gtgcgaa gtcgagccgg ggcgatggt tgccgaagg gaacctcgaa
721   gagctcgacg ttgcgctggc cgcgcgcgcc cggtcctt cgcgacgccg gccgtatcg cgcaaggg ctcgcagcg
781   gtccgtgctg gcgggcgcg atcgagcaat gcggagcat gccgagccg cccgaccgtgg cagccgccc
841   gcgcgattct cgtcagcgca gaccgccgatc gacgccgat cgtccgccgcc gcggcgcag cgagccgc
901   ctgccgtcgg cattgctcga cgcgcatcg gccgcgaag tccgcgtact tcccgaagct cgacatcacc
961   gccgcagacg cgccgaacg ctcgcagcgg gccggagagg ctccgcagg tccctgcgc gacccgt
1021  ggccgcgtcg gctatgaggc gctgcagccg gccgcacgtg cgcaacgtcg cctgtggtc tcctgtggtc gagccgacg
```

```
-continued
1081 ttcctgctcg gccgtcgc gggcagggcg ctcaagtgc cgatcttcga cgcggggc
1141 cgcagcgcgg gcgtccgcgt gcgtcaagcg aggaagtcgc ggaagtacg gaactaccgg
1201 cagcaggtg tcgtcggtt ccgcaagtg gaggacaacc ttgccgatct gcgtctgctc
1261 gacatcaga tccccgcga aagcaggtc gtcaaccgt cgccggcgc gcgtgctc
1321 tcgcacgc agtatcagga agccgggtc agtactctcg cgctatctcg cagcgagcgc
1381 tcgtgctcg aatcgcaact gcaatcgaa cagtgcacgg gtacgcagg ggtatcgacg
1441 gtcaacctga ttgccgcg ccgcggct cgggggagcg atgccgcgct cggctccgcg
1501 gagccggca agcaggacgt cgcaccgcgt                             tga 52 
  1 mnktnineri arvakiaaas gllvallaac avgpdyrrpd vatpaafkea palapgeqag
 61 twkaaepada ahrgewwrvf gdpvldalet qalaanqnlk aaaarvegar aattaaarsqw
121 fpqtvqfgp treglssasq fqpgsptn atlwraggtv syeadlfgrv grnveasrad
181 eagsqalfrs vqlalqadva qnyfelrrld sdqlyrrtv glreealklv qrrfaegdis
241 eldvsrakne lataqadavg varrraaseh aanarigak adffsetpi apvvvrvpag
301 lpsallerrp diaaaeramm sayfpkldit gafgyeatl gnlflwssrt
361 fllgpfagta ltlpifdggr rsagvaqara kydeevanyr qqvlvafrev ednladlrl1
421 ddqiraqsda vnasrraakl srtqyqegav syldvidser svlesqlqsn qltgqavst
481 vnliralggg wgsdaalgsr epgkqdvatr 78 53722229 YP_111214
  1 atgaagtcgc gttccgacga gttgaagctc ggaaaattca ccacctctg cagcgtctg
 61 gccgagctcg cggcattcgc cgcgagctcc gcggaggcgc gccgccccg cgatcacgac
121 aaggagctcg cgcccgatcca gcgccggaac gccgccgaac gtcgaactc cgaatccgt
181 tcgcgtcgg tgaaattcac cgcgcctcgg cgcgctgag ggcgagtatt accacctgtc
241 cgcagggaac tgatcccaca cagggccgc ggcgaaggc cgaagccgtt gcgcaccgtg
301 cccgcatca cgtccggac ggcgaaggc gggcaacgcg tcgagccgc tcgccatc
361 cgcggctacg cacgcaggg cagcatgttc gtcgacggga gacgcgacg gggcggcgtc
421 acgcgcgaga tcttcaatac cgagccgatc gagatccga acctcgtca gcacctgggc
481 ggcgccccg cggtgcggg ccggccgga cgggctcggc acctcgtca atgccgac
541 acgacccg agggcagcg gggctcggc tcacgggcg cgtcgcgga gagtcgcgg
601 ggcaactggc agttcgcga gccgccgacg cgtgacaaac ttccgcctga gagcgtggg
661 gacgtcgcgg gccgccgcg ggcgacgac cgtcggtcgg ccgaccgtat accacctgtc
721 ttcgggtcg ccgccgac gcggcattc gtattctac agaccgcgac gggacgacgat
781 ctgccgtccg aggcgaact gcgcattcc cgcgaacgt gaaccagcc cgtcgacttc
841 agatcctatc cgccgaacgt cgacggacat cgcatcgagc acgactcac gcgtctgtg
901 cgaagacga cgaagacgacga acaccacgg cagcaggcgc ctacacgaag actacattg gacgcagccc
961 acgtgccaaa gcggcaaccg ggcttcggc ggcaacacgc cgcaacaacaaccgcaat
1021 aacgcgaact aggcaaccgt ggtcaacgc aggctcggc gagctcggc gcgaattccg caccgcgg
1081 agcgagcgg acagcagcgc ggccggacc gaaccagacc cggcaagacc gcgaattccg caccgcgg
1141 ttccaagaca gttcaagcac cggatcaag caggacg gccgggcaa aatggggcaa gcggattcg
1201 tacaagcgtcg cgagccggac gcgaacagg gtccgacaagg tgccaacagg ggcatcgggc cggtcaaccgg
1261 tacaacctga tacaactcga gaacctgggg gtccgcaacg atcaccgaat cgtccgaccg
1321 cgaacaacg actacgcga tgcccgacc gtccacgaaa gccgcgtgac cgtcgacacg cttcgacaccg
1381 gtcagctga gcaagccatt gcaggtgaac gccgctgcc aagaccacca cgcgcatcgg ctacctgacc
1441 cgctcaccg acaccccggg gccgtctgg gaacggccgcg agactcaca cgcgacacg acgctcgtg
1501 aactcaacgc aggcaaccgt ggtcaactgcg gtccaaggt ggcaaccgtg gctcgtcaa gcgcgctc
1561 gcgagtcgt cgggcccgc gagcatccgc cggccaagc gctcggcag gctcggacc gcagtcgtc
1621 acgccgggcc gcgcgcgcgt ggcgccaac gggatcagc cctcgcagca gcctcggcc gaagaaccgc
1681 agatccgaga tcgccaccaa atggcaccaa ctgcaacag ctcgaactg agctcctgt caccgcgcc
1741 ctgttccaga tccgcaaca tcggccgc ggggctcagg cgggctccgc cgaacaaca cgtacgatg
1801 gtcgcaaca agccgtgaa acggcccatca ccctacag aagaggcgaa acagcgcgt caccgcgcg
1861 tgcaggtgtc tcgggcgtca acggcatca gtttccgaac attcacctg ggcgcgcgg cggtggacg
1921 accggacga acgacgcgga tgacgcgac cggcccgaac acgcgaaca acacttccac cggccgaacg
1981 aactacgacg tgacgccgaa attcaccgtc tcggccgcg ggcggccgg cgtctacat gtcgaaggta
```

```
                                        -continued 2041  ttcggcgata  cgcgaacct  gcgcgccgtg  ccgtatact  ggcgcttcga  ccggatggcg
     2101  cagtaccgga  tcaacaagaa  gtccgacctg  cagccgaacg  tgagcaacgc  gtcaacgc
     2161  agtacttcg  atcaggcgta  tccggcgcac  tacggccgga  tcgccgcggg  ccgctcggc
     2221  ttcgtcacgc  tcaacgcgc  ctattga 53
       1  mkrsrdelkl   gkttlcsvl   aaspafaqda   appaasadhd   kelapiqikg   aaehsykadf
      61  sssvkftapl   vdtpksvvi   pgelihnsga   atltealrtv   pgitfgageg   gmplgdrpfi
     121  rgydqggsmf   vdgmrdtgat   treifnteri   eitkgsdgay   ggrgaggsi   nlvtkaphlg
     181  ttaeasaglg   tdryrrftad   gnwqfadhaa   frlnlmshnn   dvagrdavnn   erwgvapsia
     241  fglgtptrvs   asyyhlstdd   lpdggipyfy   ttankpanvd   tiypanvdrh   nfyglvmrdf
     301  rkttdigtl   riehditpsl   tvrnttryte   stqdyiwtqp   ddsgnvvng   rvwrrnnnrn
     361  sainsianqt   elfgefrtgp   fkhsfttgie   lsrewgkrds   ysvatgtgki   cqgigaasg
     421  ynctslgspn   pndpwagsit   rrnndyahart   vtkslygfdt   velskhwqvn   agvrvddyst
     481  rftdtrangg   ktytrddtlv   nwqlglvfkp   arngsvyasy   atsstpagal   lgegsetqsl
     541  tpgrggvgan   adqlapeknr   sielgtkwnv   lddkisltaa   lfqidttnar   vtlpnnqyam
     601  vgnkrvqgle   lgfagqltra   wqvfggytym   kselrdngrn   tadnqhqfpn   tpkhsftlwt
     661  nydvtpkftv   gggafymskv   fgdtanlrav   psywrfdama   qyrinkkldl   qlnvsnlfnr
     721  tyfdqaypah   yasiapgrsa   fvtlnary 79 504 83 53721278 YP_110263
       1  tcagaaatcc   accttcatga   tgaccgcgac   gctgaggcgc   gggccggtgt   atcgcgtcgag
      61  cacgttcgaa   tcggcggcca   tccggcgact   gtccgacaag   ttccagtact   tgaggtcgaa
     121  cagttgtga   atccgggagt   gctgctgttg   gtccgtgttg   cgccgcgaag   cgccgcgcag
     181  atcgacacg   aacgacgcg   gcggccctgaa   gcaggccttt   ttctggcacg   cggccgacga
     241  ccgcgctcg   ccgcgtcacc   ccgcctgcca   cgaacacggg   gcctggcgtc   accaggcctc
     301  gctcgcgcg   tagccgcctg   cgaacacggg   ggagaacggg   ttgaccgtat   cgagcggctc
     361  gctcgcccgc   cgttgtcct   gcatgtcct   gcgtcgtgcc   gccatcgcc   tcttcaggt
     421  gaagccattc   ggcatcacc   attcggccgcg   cttcgtgaag   gccgtaatgc   gcgttcgc
     481  gaagttcacg   tactgaaca   cgaccgcgg   gtccgacgg   ccactcgtga   ccacctga
     541  ctgaagatg   aagtgagat   agagaccgg   gaaagaggc   acgcgtagc   gcagaaccgt
     601  gtagccggtg   ccgagcgtgc   cgcgcaggcc   cgcttcgagc   gtgtcgctcg   tctcgggctt
     661  caggtccgga   tgccgatcg   acgtatagcc   atagaccgga   ttcgagaag   tgttgttgat
     721  ctgatcgggc   gtcggcgtgc   gaaagccgtg   ggccatgc   cgtaggaa   tcagcgggg
     781  cgacttca   tagagcatcg   cgacgccgg   cgaccgtcg   tgatcgctcg   agctgaccgt
     841  cttccgggt   aacagcggat   cgcccgagct   tgccgaagcc   acgccctgt   cgggaacgat
     901  gccgggcag   gttccgggaa   acgcctgtt   cagggtcaa   gtgcgcacg   tcgcacacgt
     961  gcccggtcg   cgcaaatcg   agtcgatact   aagaggttg   cgctcaagcc   gcagcttgtg
    1021  cgagcggcc   gtcgtccga   gcggattgat   cgcagcaacc   cggtcgcag   acgcttgtg
    1081  cgagcggcc   cggcccgga   agcggcctc   ggcgaacgcg   gagccgccga   gcgccgccgc
    1141  gctgtagtg   ttcgagcg   aacgcgatt   gagacatctg   aggattcgcg   cgaacggtc
    1201  ctgatcgc   gtcgactcc   gtcgagtcg   agtcgatat   ctgaggttg   accccgtcga
    1261  gggggtcg   cgcaaatgc   agtcgatact   aagaggttg   cgctcaagg   tgtcgttccg
    1321  ggtcgggcc   gcaaatcg   gcggattgat   gcggatcgt   gcccgcaag   acgcgcgtc
    1381  ccgacggt   gcccgaggcg   gcttcagtc   agacatctg   gtcgagcgc   tctcagctt
    1441  gcaccagc   gattccggt   gctgaggtg   tgtcgagtcg   ccgacgccc   agggctgc
    1501  ggaattgtc   gtccccgga   gcaacatg   cctgcgcagc   gctcaggtg   gcgatcgcag
    1561  cgctcacg   cgatccgtc   ccccgagc   ccccgcgga   cgaagggata   gtgctcgcc   tgaggcagc
    1621  cgagccgga   ctcggcgga   acagggta   agttgacgc   gcccgcagg   catacagcg
    1681  ggacggatct   tcgtgatga   agtcgacgc   tgtcgagtcg   cctcaccgc   cgaatcgc
    1741  gccgcgcc   ccccggcag   tcagagga   tcccgagaa   cggccggt   acgccgatcg
    1801  gcgccggct   cgagaccg   cggttgctt   cgaacgga   agcggccgg   gcgatcgac
    1861  cagcagcgc   cggttgcc   cggtgctgc   gatgtgatg   ctcgcgccc   cgtcttcat
    1921  gcccgcagc   gccccgagc   ctcggcgga   acagggta   agttgacgc   gcccggcc
    1981  gtagcgcag   gctcccga   tgttgtccga   cgggcgtcgg   ctgctctcc   tcgaggtctg   aatcggtgat
```

```
2041 caccgatacg ctcgcagagg tgaggtcgc ggccacgcg gtggcgtcg cgtgacggt
2101 gatccgatcg agtccggccg cgtccctgag cgtcccggcg atccgccgct gccgcacctg
2161 cgactggat gcggcggatc cggcggccgc gggtcggaa cggggccgg gcggccgcgc
2221 ggccccgca tagggccga agccccgaa cgaaccccga cgaagcggc gccgcccaa 54
  1 marprlraal fgafglyaaa araagpasep aaaasaasts qvrhaaiaaa rkdapaldpi
 61 tvtatrtasa asrtaaaysv itdsdleeqq adnikdalry epgvtvrrta yrpanaalgg
121 grdgdssini rglegnrvll medgirlpsa fsfgpleagr gdyadldtla rieilrgpas
181 alysdgltg avnfitkdps dllsihrkkt yfsfrpsyds vdrigatvt aagndrvqa
241 mliasgrrgh elathgdns astrrtranp qdvyteslig kltitptard tiklaaetvr
301 rridtnvlsa inpttiglt andrlenrf sidydlrdaa argfqtahvq fyygestdqq
361 dafetrggrl qsrsrnhys eralggsafa esgfatqpla hkllygvdgs idrikslreg
421 tvaspgesfp nkafpdtdys lfgafvqdqi gfgkllvtpg lrfdayrlsp ssgdplftgk
481 tvsscdhels prvamlyevs palipyaqya hgfrftptpdq innfsnpiy gytsignpnl
541 kpetsdtlea glrgtlgtgy gplrysvaaf agryrnfisq rtvggsgrpn dplvfqyvnf
601 anarihgfeg raevmpngf tiktamaftk gttqdhgaaas epldtvmpfs avfvrvyeps
661 erwfaqadll wqagkrgrdv ssaacqktc ftppssfvvd lrggyrfnkh vsaylginhl
721 fdrkywnwsd vrgiaadenv ldaytapgrs vaysmkvdf 505 81 53721627 YP_110612

80
  1 atgcgtacg ggggtgggccg acctgagaga tcgcggcgcg ggccgcgcg ggtcggcgt
 61 ttcgggggaa ggcggtgggcg ctcgtcggcg cacggccgg tgctgatcgc ggccaccgg
121 gggccgccgg cttggccgg agacacccgg aagacggacg cgcaaaagaa cgcaatgcaa
181 aggacgaaa acgttccgga agtcgggcg cggccgcg cggccgcgcc gctccgtc
241 gccgagcgcg agcgattc gccagatgcc gctgagcgtg cgcaaccctg cgcaatcggt cagccgacg
301 accgccgagc ggatcgagca gcagaactcg gcagaactg ttcagcctcg cgcagcgag cagcaatcg
361 gccgcgtga ccgtgccagc gtacgtgtg ctgacgaccg cgtactcgt gccggcttc
421 aaggtcgatt ccgttcgagct cggcgctta cagcgccgcg ccctgccgt tcggcgacat ggccggcgg
481 cgcgcgcga tgtccgacga cgaaccgga cgagatcctgc gggccgcgc gggccctg cggcttgctg
541 cacggtcgg gcaatccgg gcgccgcgt gcgaccgtc cgcgcaggc aatctggtgc gcaaccacgg
601 tttgccgga gccgagcgt cgcagccgg acgcagatg accgccga tctacgcgct cgccagatcc
661 ggcttttct cgaccgga gaagcaggat acggcctgc cgtcaccga tgccgcaat ggccgcacga gactgggata
721 gggccgtca acccgagg cggccgcgcg gcggccttgcc gatgccgcgc gggccgcgt gactgggata cgagctgagc acgcatgagc
781 gactggcgc cggccgtgc acgtccggg ggccatttc gcggtggaa gccgcagta tcaggcggtg
841 ccgacatgt tgaaatacgc tgaaatacgc tgggcagcgc agggaaagc ataccagttc atcgggcggc gtaccggtg cagcccggg
901 agtccctcg agtcgggca agacactctc gtccgttct gggaaagggcg cggtatcgga ccatgggcc tcgccgcat caaggcctg cagcctcg
961 gtccgagca agtccggcg ggccggcg gctcaccga gctcggtga gtcaagctga aatccggcc aaggcctg catcaaggc
1021 cgtccgatc tgaatacgc tggcagcga gctcggcg agcaagtga gctcaggtga atcgggccc gtaccggtt
1081 gtcgctggt tgccaggca cgcccctcg gtccggtgc cgtccgaag agcagtgt tgcttctcg cagcctcgg
1141 ggcacgcta cggcaggca ccgaatacg ggcgcgcg gccagatgct gcctgatct tcagccgggc cgaccgcgaa cagccctac
1201 gtccggggcc ccgtccgga ccgtccgcgc gccaagagc ccgtatggt gccgacacct gaccgacgga tgctgttcg cgggaccac
1261 gccgaggca gccaaccgg gccacccgg gtccaccga gttccagga cggccggcgt gcgtccggt ctgtcctgg gaccccggt
1321 aaccgtacc gctgagtcc gagcgcggt cggcgcctg cggagccgg gccgcagta gcctgctgc gtaccggtt cccgcaggg
1381 gacatgcaga cgacactccc gtccgttgcc gcaaaagggc ctctaccgg gtcctagggtc atcgggcca gtaccggtt caaggctcc
1441 cgtcggtca cgtccgtgct cgccgtcgt gggccgcgc cctgttggt ggaaccagga tgctgttcg cgggacctac
1501 gccgactaca cggccggtcc gcggcaagct gctcaccga gctcgggcg ccagttcag ggctgcctg ggatcggcg
1561 cgcgactggt cgtccgtcacg cgcgtacgc cgcaagagc ccgtatggt gaggtgtcc agccgcagag caaccgacc
1621 tgggacggcg cgatcctgac cgcggtgaag ctccggcgt gccccactt agagacgga catcaaggggc
1681 gaatcggcg gcggccgaat cggccgatcg tcgccgcgt ttcgacggt gctctacta tcctgacaac
1741 aatccggcg gctcggtacc gccccgg cgtccgacgg agggaaacg gacgcatcac gccggtcgg
1801 ggcacggtg gcagccggg gagctcgacg gttcgaatc gttcgacgacg gacgcatcac gccggtgtgg
1861 agtgtgggg cagctccac cgccggggt gttccagcg atccgctatg cgaaggatgt cgccaaacgc
1921 ggccgttcg cgggcggact cacgccgcgc cacccgctc cctgtgttgg cgtgtggac gaactacgac
1981 ctgccgtggc aggagccgg aggagcccg ctggagccgc gcaggcggcg tgcaggtgca gagcgattc
```

-continued

```
2041 tcggcgcgt cgagcggcgt cacgatgcgc cagggcggct acggcgtcgc gacgtgcgg
2101 ctcgctatc gctacgacg gccgctggcg gctgggcgtg acatcaacaa ccgttcgac
2161 cgcacgtact accagagcgc cagccagccc ggctgaaca atcgttatgg ggagccgc
2221 aacgtgatgc tgaccgtgcg cgggcagtc tga
```

55

```
  1 mrygvagper srrgaapygr fggrrwrssl clgvliaahp gaaalagtaa ksdaqkndmq
 61 rnenvredtr rlaagappag gelkaivsa pkdaaddpsv atvgkmplal relaqsvsvt
121 trerieeqnl fsldvdmqs agtvpyvl lttayfvrgf kvdsfefdgv pvvlgdmasa
181 pqdmsayera eilrganll hgsgnpaatv nlvrkrpqhr faaasvgsw gryraqadig
241 gpinpagtvr grlvaayedr gffydrakqd trsiygiaei dvardtlvtv gadyqsvasv
301 pdmsgvpmar dgtslglprs tfldvgwqhf dwdttrvfgs verlggqwk akvsgeyqav
361 rsdlkyagay gaidratgag gtlmgsayqf ssysrsvdan vggpvrafgl thellfgaty
421 asssgqlta pllagagtpv nvyrwnpdgv pepgvgpyrq dmgqndisqkg vyglrikla
481 qpvtlvlgqr lswwnqdslg ahynagrqft pyggliwdva rdwswyasya evfqpqtkpt
541 wdggiltpvk grtyetglkg elaggklnvs laafridldn npridatrpc agrscyyvng
601 gsvrsgqfef eangritpww swasytfdt iryakdvang gafaeltpr hllrwtnyd
661 lpwgerrwsv gggvqvgsdf saassgvtmr qqgyalasvr lgyrydrhwr aalninnlfd
721 rtyygslsgp gwnrygepr nvmltvrgqf
```

81

```
   1 ctagaagcgc agctcgcga cgagccgagc gggccgagca gccattgcgc
  61 gccgccgttc gactcgacg ccgctgacgc gcggtcgcg agtccgacgc catagaacgc
 121 gagtcgacg tcgcgacg ccccgtcgta gagcaacgcg acgtaccccg tgtaagaagg
 181 caccgcacg ccggtcgcgt cggttccggg cgcggaccg acgtagcgcg ggcccgcgtt
 241 gcccgcccg ccggaccgg acgtgccgg ttccgctct gctcgcggat
 301 gtcgtgcggc agtgcccgg acgcggcgc gacccgcgtt ccgacgcgct ggtcgaacgc
 361 gtcgtaggcc gcgcagca cggaccgcga cgactcggcg tgcaccgt cggcgccgcg
 421 caccgccgcc ggatcgagc tgatctcgcg cgcccgccga tgactgcgct cggcgagcgc
 481 cggattcagc cgagcgccct cgatcctgtg gcttcccatt gaccgccggt
 541 ccagtacgcg cgagccgcga cgattcctgtg cgagccggat gcgccccgt cgccctcgc
 601 cgcgagccgt tagttcgct gcgaccgcga gccggcgcg agcgagccca cgagcccgct
 661 accgtcgtg tactgcgt acgtcttgtc gaaccgccg atccgtaga cgagcccgct
 721 gcgcagccg gtgcgcga agtctgtc aaccagagcc ggcgagccg gtgcgaacct gatcgtcgcg
 781 atgaacgaa agatgcgt cgatgaacgc gctcaccac cgagcgaccg gcagaccgt
 841 gagccggttc cgatgaacg ccggatcc atgccggcg gaagccggcg gtcgaacct gcgcagcgc
 901 cggatcgggg ctcgaaacg ccggtgcca cgatctggg ggcgaccgg ttgaactcgg cgccagcgac
 961 atgaaacga agatcgtcg ccggtgtca ccggcgtgaa gctcaccac ccgtgcgaa gtcgccgaa
1021 gagccggttc agtacgcg cgcgcagcag cgtagtcgc ggagtcgccg cgcgccgcg ccgagccgg
1081 ctgccgctcg cgatgcca tacgcggcgcca atggccgcg gtcgacgagat gcgcgcccgg ccgagtcgta
1141 gtcgagcgca cgagccgcga cgagccgcg cgagccgtt agccgccgcg agtagcgcg cgagcccgcgt
1201 ggcatcgagc gtcagccgt ccgccgacgt tgccccgcga cgacgaagcc ggtgcgcg gatggaacg
1261 gtgtatgcgc atcgtccgg ccggacgtt cgtgtcgac cgtagtcgac ccagcgcg tttcgcctg
1321 caccgccgtg gtcgccgg acccgccga gccggaata cggttcgcg gcgttcgcgg gggcacgac
1381 atcgagcgtg atcgacagac gcggaatcgac gcgagccgcc cgtatcgagc gcgccgttc cgagcgccg
1441 cacgtgcgcg atctgccgt ccggccgt cgacgagccgt cgtatgaacg gccacgccg gatggaacg
1501 ataggaaaga gcgccgccgaa ccgtcgacca agtcgactcac cgattcgtac gccacgccg tttcgcctg
1561 cgtcccgcatc gtcccgga gccccgcgt cgcgtcga gccggcggg gcacgcgc gggcacgac
1621 gttcgacg gtcgccgatc cccctccgcc gtacagcacc cggaacgtg cggcccggcc cgcgcagac
1681 ctccgatgcg tcggcgaca agtcgcgaca cggaacgtg cggaacgtg cggcccgg cgcggggta
1741 gagccgcgcc ccgtacgcg ccgccgtcac gcggccgcgc ggccgcgcg cggccgtg ccgccccggt
1801 gagccggtg ccgccgtg cgggccggc cgggccggg ggccgctg gccgcgtg aagccccgac ccgcccgac
1861 gggtcgcggg atcgtggat cgtcgaggc cgcgccgctt cgcgtcgcgcc gcgggaggccgga gcgccccgac
1921 gctcgccgcc cgtgcgag tgtcgaggc cagcggcgaa aggcgggc caggccgaga gcgcgtaga
1981 cagcggcgac ggtcgcacg ggtcgccgt cgtgctcgt caccgctcgt caccggcagt cgcgatgcgg
```

506   88   53720334   YP_109320

-continued

```
     2041  gcgccgcg  ggtcgccg  gttcccctc  ggggccgag  ggccgcgag  gcgccgacg  cgtcacgc
     2101  gcaccgagc  gcggtcgac  agcactcga  gcgaccgag  ggccgtcga  cgaccgacg  cggccgcaa
     2161  gcaccgtgc  acggccatg  cgacaggcg  cgacgcgag  gggcgagcg  cgggagcag  cgccgcgaa
     2221  cccggccccg  aaccgcgac  ggccgacgg  tgcatgcgg  gcccggctca  t
```

```
56
       1  msraphapsr  rrafgrgfaa  aaraahgapv  ahgvhacfaa  asrrstavec  cvtalacavt
      61  asgalaaeae  padaarqphr  elptvvrtsd  gahaasplstp  laagsrlkla  sldtpasvea
     121  itsaqiaarg  drtivdavtr  atgfstaaap  gnggtalsvr  gfaaqesvtt  lvdqvrlypq
     181  agtvtfpfst  wsaerievlr  qpasvlvqeq  aigqvanvvt  rprrersstt  lqaqiqtqe
     241  krvaldttqa  lqarlsvrfh  lsdertrqfv  erqdahvtav  qqalkldvds  rlsitldvdv
     301  qrqkpatvfq  vpatnqvler  alrernynvq  datiayhdtw  trlaatvraq  nqvtldaqly
     361  ylatrrhwrn  aesyaldpaa  rtvarsdyle  ifhrerqfqe  rftaridsrv  fqranrlvlq
     421  aefnqiafdq  annapyrqes  tvaaqfdpq  afaspdptlp  rfrtrthqaa  aflenrlevl
     481  prlawvsqlr  ydhisfhrdd  liaqqafdkt  fahtqwrsql  vyeiapqlaa  yaqttqaqq
     541  vqslvtlsas  qanvtlatqr  qweaqikhei  dqaraywtla  vydivkrqlv  svdpinpara
     601  qqiqrqssrq  velaqqvrlp  qqvtvdanaa  llraryaafd  qrvqdtvvqr  aqnvphdiaq
     661  qsanlwiqwa  fapqwranaq  lryvqpryqd  danrvpvpsy  tvfdaslawr  atrdvdlafy
     721  arnlanrtya  astsnqqaqw  llqpsrvel  vatlrf
```

```
507  81  53722763  YP_111748

1  tcagagcctq  gtgctcaaac  gaaccccagc  ggtaccgacc  gaggttcagg  cagccagatt
      61  cgccgatag  ccgacgttg  cgtgcccgc  cgtccccggc  tgctccgcat  aagccttgtc
     121  gagccgttg  tgacgccga  cggagctctt  caccaagtcc  cttcacqttqt  actqcqqtq
     181  gcacgcagc  acgccgaaac  cggccgtcqq  accaaqtcc  agccccqacq  cqtqcccqc
     241  gttcqacqc  tacccqatqt  qcqaqccqqc  ctcqaqcqqc  qqcatctqcq  cqaccaccqq
     301  cccqqaqtq  aqttcqacc  acqqttqqcc  cqaqcqtqa  cqqcactqcq  qcaccqqqc
     361  acqctttqc  acqttqqcc  ccaccctcac  ctcqaqcqac  ccttcqaaqc  qcacqqqc
     421  qaqcqqacqc  tqtccccaca  qccccatqat  cqccatqaqc  tqccqttqa  cqtcqtcqc
     481  ctqcqtqatc  tqtcccatqc  qqccqaqacqc  qccatqqaac  aqqatqaaqt  cctqcacqta
     541  qcccqcataq  cqqacacccc  aqqcqtcqaq  ctqtcqctc  ttqtactqcq  cqccaqtqtc
     601  qaqctqcqtc  qtcttctqq  qcttqatcqc  qqaqaatqcq  ttqatcqaac  cqttcqqqcc
     661  qcqtqqqcq  qaqaacaqct  cccaqtaatc  aqqqaaqcqc  tqcacaqcqc  cqatqcccqc
     721  qtaccacqtq  aqqqcaqcq  acqqaqatcq  acqttctaq  cqctcqtaq  cqtccqccqt
     781  cacqqcqaq  cqaaqatcqt  cqtcaccaq  qtcqccqatq  ctcactttca  tqccccqt
     841  cqtcqcqqc  ttqtccqcc  cqqcccqqc  cqqqaqccc  qtccaccqqc  qcaqccqcqa
     901  cqqatccqac  qctaccaqq  qcaacqtqta  qaaccqaaqc  qqccqqccca  tcqqcatqct
     961  cqqattcac  qqttcqtqc  qqtccacqaq  cqaqatctq  catccccatc  accqtqttta
    1021  qttcaqcqq  qqaqcaqcq  cqtqcqatqc  cttqaacqq  qtccqttqt  cqaacttcaq
    1081  acqaaacqtq  cqcatcqatq  cqqccccqa  aatqcqacqc  qtccattcq  cqqccqcqta
    1141  qctcqtcqqa  tcqqqcatcc  qqttcqttq  tcaqcctaq  ccqcqtttq  tccaqccqaq
    1201  qaaqaacqtq  cqaacqctqc  qaqtqqcqat  qqttcqqqct  qaaqacaac  tqcqtcttcq
    1261  accqaaacqtq  tcqccqqa  aqttctqat  cqaqcactt  ccqqacaacac  aqcqccqta
    1321  qcqtcqcqc  qtqcccqqcc  qtqccqccc  tcaqcctqa  ccqqqqccqt  tqcaqccqaq
    1381  cqccqqtcc  qqttccact  tqtccattq  qqtccqqct  cqaqcacc  tqcqtcctc
    1441  qtaqtccqc  qaqtqccat  aqtqccqqct  ccttqqcqq  taqaaqtcq  qcqaqccqq
    1501  cqtcqcqq  aqtcqtcqa  cqqtcttqa  cttqccqccc  aacaqcacqc  tqcqqtccqa
    1561  qccatqqcc  qqctcqqc  aqcqcqqqt  qcqccqqt  cccctqaqc  aqcqtcacct
    1621  tqcqqqccq  ccqtaqcq  cqqtqcqqq  qqtctqqq  cccctqaqc  ccqqcqtaqt
    1681  ctcqqqqcqc  atqtacqaq  tcaqqcqqct  cctcccqc  catccqqcq  cqacacqctq
    1741  cataqccqc  aqtctcqqa  tcaqqaatqt  tcaqqqaatc  aqccqaacatc  tqqqqqtqa
    1801  qttcctqcc  cqaqcqcqa  tcaqcqcqa  qccqqqaatc  cttcqaqat  aatcqqcqc
    1861  qtcqtcqc  qqcaqcqqt  qtcqcqacqa  qcqcqaqat  qtccqaqcq  cqaqqqccc
    1921  cqattcqq  qccqaqcqa  cqqcqaqcqa  tttcqatcqt  cqqcaqcqtc  qtqcqtccq
    1981  qqtcqtcqq  cqqctcqcc  cqqctcqa  accqqccqt  cqqcqcqqa  ccqatttqc
```

82

```
-continued 2041 gctgcgccgg tcggtgtcgg cgcggtgtcg cgcggtctgc tacgccggac gcgccgagcg tgccgtggcc
2101 gtgcgacggc tcgctgcct cgcggacgag cgcgacgagg cggaaggcgc tgaaggcgag ccgggcgag
2161 cgcgggaacg gtaagcgtga tcgcgccg cggccgagcg cggggcgc ggtggtctc cacgcgcgt
2221 gggcgcgtga cgcaggaatg tggatgcat

57

1 mtstflrhap targdharrr rraitlvpa laagafhlap avaqtseavh ghgtlgasgv
 61 asradtdaas aksdgavrea asaaasrttt gaapdattlp tieivaapes tplvvvtdpk
121 tprqplpasd gadylktipg fasirsggtn gdpvlrgmfg srlnilangm ptlgacpgrm
181 daptsyiape sydkvtlvkg pqtvlygpga sagtvlferv tprfktpgmr fdgsvvggsf
241 grndqnvdvt agtpdfygrv sanhahsqdy edngrtvps qwdkwnadaa lgwtpddntr
301 leltagtgdg yaryagrgmd smpmrmaaev rrrtlgarva gahfrretfg lkfdkthigd vldridaqvf yneadhvmdn
361 ytlrmpdpts smpmrmasev rrrtlgarva atlrltdafk lvtgvdaqsn rldsramgm
421 qnygdkpwnp qanmwnagaf geltwyasda srviggarid yaaardkrat tgmkmsmrn
481 ptfddlrsrv lpsgfvryer diaslpvtwy agighaqrfp dywelfsakr gpngsinafs
541 aikpekttql digaqykdk ldawsayag yvqdfilfdy atgpmqgitq atnvnaqing
601 gevgaswrpl aptvgfegsla yawgrnvgsg aplpqmpple arfgveytrg pwsagglwrv
661 vapqhryaln egnvvgkdfg psagfgvlsl haqynvsktv qisvgvdnvl dkayaehlnl
721 agnagfgypa nlpvtepgrt awvrlstkl

83

1 ttgcacgcgc cgtcacgcgc gcaattcg cccgcgcgcg cccgaatcg cgtcgtcgg
 61 cgcgtggccg cccgggccg gttctccgga cgcgtagac attccggcgg tgccgctga gggcggtg
121 gagccgccgg accccgcttcg ggcggagcc cgcgtaccc ctgtcgttcc cgggcgagct gaccacggc
181 acccgtctcg gctgcgaacg cccggcctca cggccgcgcg gatccgccg cggcgagct ccggcaggc
241 ctgccgacgg cgtcgtcgc cggcgcacg ggctcgtcc ccgagcggcg gctaacacg cgcaggccc
301 acgggcacgg ggctcgccgg cgctcgccgg cccgcgatgcc gacacgcgg ggccacgcg cggagcggcg
361 cccgggccgg gtccgcgcgg cgcgagacgg gctccacgcc ccgagccgcg cggagcggg cggcgcgcg
421 gtccgcgtgc gggctgctgc gcgaccagg gtccgcaag cgtgagcgcc cgtgcgccat cgtgacgcg
481 gggctgctgc gcgaccagcg cgacagct ccgacacg cccgccaagcg cgtgacgcg cgtgacggc
541 caggcgctgc cgcaccagcg gcaaccagct ccgcgcaat ctcgaccaag cgtcgacacg cgtgacggc
601 atcacgcagg gcaaccagcg caacagcgt gatgccgcaa caggacagcg tgatgaagcg cggcttcgg
661 gacaaccgcg acggctcgt cgaagtgcgt gaaggcccga ggaatgccga tcgtcagg ccctcgctg gtacgagacg
721 aacgcgacga cgagaccccg cggcgctgct caacggcgg cgaagcagg acgagcgg ggcagtccg gcctctgcct
781 atggacccgg ggcgctgtgt caacgctcgt gatcgctgc acggccgg cgtcgtcg gctcgtcc cttcctgatg
841 gcgatctcgg cgtctcgtc gacgtctgc gacgtcgcg gctgctacc gctcgctccg gatccccgg
901 gactcgacgg gcgcatcgg cgatcgcgaga gatccgccg acggcgtgcg gtgcatacc cgtcgtcgc gcctcgtcg
961 aacgaacagt attggccgaa ctaccgcgag accggccgcg gcaaccgccg atccgtcaa gggccgctcc gcctctgatg
1021 ggtcgtcacg atcgccgcaa gccgcgctgg cgcgctaccg acgccgtccg atccgtcaa gggccgctc catcctgatg
1081 ggtcgtcagc gcgaccaccg cggcgccctg cgcggatcc cgcgctgcg tcgtcgtcaa ccaccgtcg accgctacg catccgtac
1141 cgccggccgc tgcacgagcc gttcaacgac gccggactcg cgcgatcg aatcgaatct ccgccaagtc ctaacccgg
1201 gcgatcgatc atcagcgcgc aggctaccg gccggacatg aggtgcacg cgatcaagac gccgttcacg
1261 gagacctacg atcgccaca gattgccca ccggaacca acgagccga atccgtcaa gggcgcctc ctccgacagc
1321 acggcagca acgacgcagca gcacgctcg gcaccgctcg cgcagcgaccg acgagctaccg cgcagccg catccgtac
1381 gtccgacggc ggcggacgct cggtctaccg tggtcttcgg ccgcgcacagag accgagcggg cgggcgagc gctgcgacgc
1441 gaatccgcc atcgagcggcg cgcctaccg gctgtcagag cggaccagcag agtgctgcc gtcgacagcg
1501 tatctgacc atcgcagaca agctacgcgg gctgctgcg ctgctgctccg ctgttccctc agacacgcat ccatctgagc
1561 gaccagagcg acacgcagcg gcacggccg gcagcgcct cctgtctcc aagacagcat ccatctgagc
1621 gagcgtgga tgctcgtcgg cgtcgtacat cgacaagag tggcccgct acaagcacgt tgcccggagc
1681 ggccgcccgt tccaggcaa cgcgcacaa cggcagcga agtgctgcc gtcgacggga gcggcgagc
1741 atcgtctcaca aptcgaacga ccgcactcg cgctaccgc ctgtacgca ggctacacgg gtcccgcgga
1801 ccgacctcga agatcgccgc gatgcgcgc gtccgtggga gacgtcgcga ggcttctcg ccggctcgcc
1861 gaggaaagcg cgtcgtggg gtctctgcat ccggctggg aagctagcg gcaaggacat ccatctgagc
1921 acgtcgcgt tcttcgacat ccgacatgc cgacgtgcgg agtgctgct gctgctgct gctgacgacgc gacgacgcg
1981 acgaaccaga cggcggccgg caggcggc ccggtcgcggg cgctcgcct ccgcgcgct gcgcgcgac cgagctcgac
```

508    81    53722050    YP_111035

-continued

```
      2041 gtgtcgggcg ggatcggcgc gcgctggaac gcgctggaaa gtgatcgcga gctacgcgta
      2101 aagacgaccg aagatccgct gtacggggcg cgacggtcgt ggaacgtcgt cctgcgcatc
      2161 gcctgctcg cggcggtcta cggcggggc cgggctgcg acgggctcg gcggcgacga cctgcgcatc
      2221 ggcgcgcgg ggcctacct cggcgcgcgg cgcgtccgc ccggcgcatt cggccaacag cttcacgctg
      2281 ccggcgtacg cgaccgccga cgccttcga cgcgttccga acctacgaca cgcgcttgg caagcagaag
      2341 ctgcagttcc agtcaacgt gaagaatctg ttcaaccgca cgtattaccc gtcagccgtg
      2401 aaccggttct tcgtgtcggt gggcgacgcg ggcgacgcgg cggcagtgtt cgctgtgac gacgctgcga
      2461 ttctga
```

58
```
        1 mhapcmpqfa pqfaprrrva rvaaaalfsa caapgvsgaa epaaatrayd ipagpldaal
       61 trfgreagil lsfpgeltg lrspglhgra dpaaaldrll tgtglvalrq psggytlarl
      121 pgpaaagada aladttlpt vavrasgpha dsyrpreaa glrsdaplae vpqavaivaq
      181 qvlrdqrpn lddalanvsg itcgntlgst qdtvmkrgfg dnrdgsvmrn gmpivqgrsl
      241 nattdsevl kgppasllygi mdpgvinvv tkqpqlarrh aislagstyg ggrnggelf
      301 dstgaigesr vayrllvdqt neqywrnye hretlvapsl awygrdtqvv lseyyrrflm
      361 pfdrgtaldp rtnaplaipa rrrldepfnd mrgesnlaqi aidhglapdw kvhgysynr
      421 etyqanqiri tavdplkgtl trsendathgs rstdsygiay vdgrvtlagm rhdvqfgvdg
      481 eyrgyvradm lrqpiktpfs ylnptyglvp pstsyasds dqsdtlhtas lffqdsihls
      541 erwmlvggar wrrysqlagr grpfqvntnl sgtkwlprag ivykwndals lysytqslk
      601 ptskiapmag gyvidgstap eegaswelga kldmpgglag tlaffdidkk hvlvsqyda
      661 tnqtawrtsg rarsrgield vsgrigarwn viasyayida ktteqplyag nrlwnvarht
      721 aslaavydvq tvlggddlri gaagrvygar pgdsansftl payatadafa tydtrlgkqk
      781 lqfqlnvknl fmntyypssv nrffvsvgda rqvslittlq f
```

509 27 53718641 YP_107627
```
        1 ttactgcgcc gcttgcggcg cgcgcagta gatctcgacg cggcggtttt gcgcgcggcc
       61 ggttccgtt gcgtgtcgg cgatcggggt ccgaggggtt cgacgcgccc atgccttgcg cgacaggcg
      121 gtccgccg acccgccgct gcgcgagcgc gtcacgacg cttgcgcgc gatttgcga
      181 cagccgttga ttccggttca gctgtcgcgc ccggcggacg gaggcgttc agcagcggt tgaaccgcgt
      241 gatccgcgg tactggtcgg tcgcgaacgt gaccgagctg ggcacgttca gcttgagcga
      301 cgtgatcgcg tgttcggtga ctgtcgtgtgc cgtttgctgc gccgacggcg gcttgagcga
      361 gcgctccggc ctgatcgct tgcagtgtgt aaccgtcac agccgcgacg agccgccga cgcggcgcc
      421 cttgatcgct cgcctcgtg gccagcgag cgcagcgaga cccgcgatg cccgccgcga gcgggcgcc
      481 gatccgcgcg cggcccgtg ccgacagccg tgttggtgcc ttgctggtt gcgcaaaccg ccagcagggc
      541 cgtccggtg gcgaaacg acaagccgt cgcgattttg cgcgattcat gtattcat
      601 gccggcgaga
```

59
```
        1 mntkiatris vfalagalla gcatqggtnt avgtgtgaal gagigalagg gkgaaigagv
       61 galvggvtgy nwqaiknkla psaqttgqv teqpdgslk1 nvpssvtfat dqyaitpaft
      121 plindlatti nqnpqitasv vgytdstgsa ahnqtlsqmr aqsvvnalaq rgvaanrlsa
      181 qgmgasnpia dnateagraq nrrveiylra pqaaq
```

510 19 53720375 YP_109361
```
        1 atgatgtcga agaaacttcg tctggccgtc gcgatgctga tgacggcgca gctcgcggca
       61 tgcaagtcgg gctgaagct gcgacgcag gcgacgcggt caacgacgca gaaccgccgg
      121 ccgatcccg aaaacgtcgc gcagtcgcc gtcgatccgc tgacgatcgc gaacgacccg caataccag
      181 ctccgcgagc gcagcgtga cttcgattcg gcgatcttcc cggtcagca cgcaacgcca cattctgatc
      241 gcgctgctc agcaacacg gcaatacctg aagagccatc aagagcaaac cggcaaaggt
      301 cagggcaaca ccgagagcg cggcacagagc gctgtcctg tcggggtcg gggatgcca gatggagcc
      361 caggaagcg tgcccgggc gccggcacc ggcggttcg ctcggccg cggcgcacg gtgggcgcag
      421 gtgagtctcg gcaaggaaaa cggccccacg gcgctgacg ctcggccacg acgaagcgt gtgggcgcag
      481 aacccgtg cgacctcgt ctatcaacag taa
```

85

-continued 511  24  53720132  YP_109118                                                                                                         60

1  mmskklrlaf anlmigalaa cksgvlkldeh anqgdaystq pnpenvaqvt vdplndpnsp
   61  lakrsvyfdf dsysvqdqyq allqqhaqyl kshpqrthili qgntdergts eynlalgqkr
  121  aeavrralsl lgvgdaqmea vslgkekpva lghdeaswaq nrradlvyqq

86

1  atgaataaac tttcaaagtc cgcgtcatt gcagtcaccg cagtatggc tgcatccgct
   61  tcggcacagt tgtggatgaa cgtgacaca gccgactgggt ggaactgggt gaatgcacg
  121  ggcgaatggg tgtggatgaa cggcacgaaac cagctctgct ggcagctgtc gttctggacg
  181  ccggcaccg ccaactgcaa cggcgatgc cacctgtcg ccaggcagc ggcaccggcg
  241  ccggtcgcac cgttgctcc ggccatacgg agccagaga ttacgtacca agccgatacg
  301  ctgttcgact tgacaaggc ctgcaaggc cgtccgaa cggaccggca tgacgaactg
  361  gccgaaga acaagtcgaa gaaccgtgaa gtggtcgtg cagggccta cgtcaagtcg
  421  atcgtttcg acaagtacaa cacgcgttcg tgcctgcgc cgcgcaagc cgtcaagtcg
  481  tacctcgtca gcaaggtgt cccggcgaac aagtctaca cggaaggcaa cgctcgcctc
  541  aacccggtca cgggcaacac ctgcaagcag aagaaccgca agcgctcat cgcctgcctc
  601  gcaccggacc gccgcgtgga agtcgaagtg gtcggcacgc aggaagtgca gaagacgacc
  661  gttccggcgc agtaa

61

1  mnrlsklafi aatavmaasa saqsvpasrq avndnwngt gewwmngtn elcwrdafwt
   61  patanakcdg alvaqapapa pvapvapait sqkityqadt lfdfdkavlk pagkqkldel
  121  aakiqgmnve vvvatgytdr igsdkynrdl slrraqavks ylvskgvpan kvytegkgkr
  181  npvtcgntckq knrkqliacl apdrrvevev vgtqevqktt vpaq 512  40  53720170  YP_109156                                                                                                         87

1  atgaaaaga ccctcatcgt tgccgcttt tcgcaacggc cgtcaacggc
   61  caaagccaca cgagccgatc tcaactacga gaacaaaccaa
  121  ggcgccaca gcgcatggtc ggctcgtca ggtcggcatcg ctgggcctg
  181  cgcggcccg aggatccgg acggcagccg aaggagattt aaacggcttc
  241  ggcatcaata acggcacgt gaagcagaac ggccgagt tcggccgtca ggcgttcgtc
  301  acgagccgtc acggccgcc gtgcgctgc gtcaatacga cagcgtcgtc
  361  gactacctcg ggcctgtgc gtgacacgg acgaattcg gggcaacga gttcgcccaa
  421  ccgttcgaca agacaacct gaaattccgg ttccggatca caacgcggt caagtacacg
  481  agcgtgaact ggcgggcct tagcgtacg gtcgtaca caatcag
  541  ttcgcgaaca accgcgctta acggcctgga gaaccaacaa tcggcccgg cttcaacatc
  601  ggccgccagt acctgcagt gaacaacaca tcggcacgag cgtcctacg ccatccggc
  661  gcgtcgcgc tgcaacacg gttcgtcggc aacgccagc aagtgttcgg cgtgttcgg cgtcaaccgc
  721  aactacacgt tcggccccgg cacggccggg cgtcgttca gtcgagcg gcattgcct cgacggcacg
  781  gcgacggcaa tcggcgcggg ccatgggcg gtcgagcg ccgtcggg gcatgcagc ggcatggacg
  841  ttcatgcgct tcaacaacta accagcagga cgcaattcg gcgcgacgcg gcatggacg
  901  gtgccggtt cgtcacgta caccgccgg ttcatcgaga accacccc cggccggaac
  961  caattcaacc tgcaaacggc acgagccgca gcgaccgcta tccaagcgca cctgcaaggc
 1021  gtgtatcaga agtcaacaa acgcaagga cgaccggcg cgtcatcaa cggtcggcac
 1081  gtcatgcgt cgacgcagt acagatgcgc gacgacaacg gacgcggcg ccgcttctaa 513  44  53721967  YP_110952                                                                                                         62

1  mkktlivaal sgyfataaha qssvtlygli dagitytnnq gghsawsgst gsvngsrwgl
   61  rgaedlgggl kaiflvlengf ginngtlkqn grefgrqafv glsheqygal tlgrqydsvv
  121  dylgplsltg tqfggtqfah pfdndninns frimnavkyt svnwaglkfg alyfsnnnq
  181  fanmaysag vsysyagfni gagylqlnmn fgptvsnasg avaldntfvg krqvfgggl
  241  nytfgpatag fvftqsrvnr ataigagasg vssgialdgt fmrfnnyevn aryaitpawt
  301  vagsytytag fienhhpgwn qfnlqtayal skrtdvylqg vyqkvnndgt glgayinglg
  361  gmsstekqia vtaglrhrf

88

1  atgaaaaagc acgtcattc cgcagccgca ttgctggcct tcgcgcgcgc cgtttcgcc
   61  caagcagcg tcacgctgta cggcctgatc gacgccggct tcaactacac gacaacgtg
  121  aacgtcaacg ggtcggcaa gagctcggca gagcttcgga gcgtttcgt gcaggcagc -continued

```
 181 cgtcgggctc tgccgcgctc ggaagacctg caacgggccg ggcggcgggc cttcacgtc
 241 gaaaccggtt tcgacgtgaa tcggccgcag ctcggccgg tacgcctgga gttcggcgc
 301 caggcgttcg cggcctcgtc gcacgccgca acgcgaacg acgctccgg cggccagtac
 361 gattcgctcg tcgactacct ccgcgcgtg cgacaacgt accgcgaacg gcaactgctg
 421 tttctcgatc cgttcgacaa cgaccggact gaacctggcg caagtcggcg caacacgtc
 481 aagtacgcga gcccggggct tctcgaacaa gccccagtac agcatcggcg gcactagcaac
 541 ggcagggct tctgcagcaa ccgcagcggcg aacaacccgg gcaagacggc gtggggcgc
 601 ctgcaacttg cggcaacgcga cctgcaacga gaccgcctgc gcatcttcgg cggcggcgc
 661 atcgccgaca acgacgcgga cttcacggg gacggtcggt tcgtctaca cgaagaccga cgtgaagaac
 721 aactacacgt tcggccccggc cgctctatct gcgacggcgt gcttcggcct ggtccggct gagcgcgac
 781 ccggtctcga cggtcacaga acttcagaat gcgaaggcg acgttcgcgg agccggcgc cttcatcgc
 841 aagttccaga acctgcaaat caacaacgaa taccagcgga cacctgccgg caggccgag caagccgaag
 901 gcgcagtacg tgtacacgga cgcaagtc cgcggactac gatgcggccg aacctgcga agccccacga cgtctatcg
 961 taccacacgg tcggccctgat gcggactac gcgggcgac aagacgggca cgatcgcgga tggcggctac
1021 caggcgcgt accagaaggt cggaccgac ccgggcgcga agaaccggtc cgatcgcgga tggcggtac
1081 gtcgtcggga cggaacggct ctcggccgcc ctcggaacga tcggggtcg cagcacgtc
1141 cgtcacaagt tctga
```

63

```
  1 mkkhvisaaa llafaapvfa qssvtlygvi degfnytsnv nvngvgksny qlasgfvqgs
 61 rwglrgsedl ggglkaiftl engfdvnngr lgqqgmfgr qafvglshaq ygsltlgrqy
121 dslvdylapl tangnwggtl fshpfdndnt dnsfrvnntv kyaspdwngl qvgtysfsn
181 atgfsnnrqy sigaaytlgg lqlaaaylqa nnpghtagga iadndanfta drlrifggqv
241 nyftgpatvg fvytktdvkn pvstvylpta tfagiglsat kfqnfeingk yqltpalfig
301 aqvyvtdgkf daaagsvkpk yhtvglmady nlskrtdvyl qgayqkvagd ktgtiadggy
361 vvgtcdgpsas anqfavraai rhkf
```

514    89    53721903    YP_110888

```
  1 atgaacaaga ctctgattgt tgcagcagtt cgtcgctacg gctgcatcgt cgtcaaccgt cgtcacgcg
 61 caaagccgt tcacgcgtgta ccagtcgtcg cacgtgtcc gacgggggca tcagtacca aagcaaagtc
121 gcgaccccgt cggctccggc tgccgcgtcg caagtcccgg tggtcgcggcc cgaccaaagc cgaccaaagtc
181 cgttccgtc tgcccgatcg tcaacaccg gaagacctg tagcaactcc acgcccgat cttcaacgt
241 gaaagccgca gcccggctgcg tggtctgctc gagcaactac ggcaaacgtc ggcgcggcat gtcgtaaccgt
301 caagccgttcg tggtctgct actacctgc gccgcgctgc gcaactcggcg ctggggcgg cactacttc
361 gcaacccaag caacaccgg actacctgc accccgcgcg gcaaccgcg ccgctcggc acgtactcg
421 gcgcaaccgg tcaacaacga cgcgccggcaa cgcctgaac ccgggcctgc acgaattcg gcgcgccggt ctcgttccga
481 gtcaagttca cgagccgaa ctacgccgg caacctgca cagccgcgg gctcttcgtc ccaggttcca
541 aacaactcgc aattcggcca caacaactg gtactccgaa acgccgcgg ctgccggag cacccgggc
601 ggcctgaagg caaactgcaa cgacccaa gctaaccag acgcaaccg ctgccgcggg catcccaagc
661 gcaacggatc ccgctgaccg cgctgacgcg cgcgcacatc ggcagcaag gcccaaggc agcgcgctg
721 cgtcgcgcg tgcctgcgcg caagctacg cggcaaaccg gcaaacgcg gccaccgcg ccgtcccgac
781 ctcctgacgc aatcgcctct tcggccgtcc cgacacctg gcaaacgcg acgacccaag ccgtacgac
841 aactacgaag caaactgca gtacaacctg agcaacatct acgcgcgga gcgccgggcg tgttgcttac
901 agtacaacga acgaaggc cgcgaacgg gaacgcgca agcacccac gaaccaaagt tggcgtccag
961 gccgactacg cgctgtcgaa gcgcaccgaa gcgctacgac gtcgacgcac ccagcgttcg
1021 tcgaagaacg cgaatgcgtc gatctacaac ggcgacctca ggcgactcca cagcacgtcg
1081 atcaaccaaa ccggaccgct ggttggtctg cgtcaccgct tctaa
```

64

```
  1 mnktlivaav aasfatvaha qssvtlygvl dagityqsnv atpsgsgksl wsvgagvdqs
 61 rfglrgsedl gglkaiftl esgfnigngr fnnggmfnr qafvglsnyy gtvtlgrqyd
121 atgdylspls atgtwggtyf ahrlnndrln atqdylsgqf glkvqaysq annagantg atdpltgfni
181 nnsqfanra ysagasyqfq glkvqaaysq lwtqsrldnl angapttrad nyeanykynl ggtnaasigg
241 rsrvygasa yavgpllqgl lwtqsrldnl adylsakrtd adylsakrtd vyqgqavyqrs tpalgvay
301 tythakange sthwnqvqvq adyalskrtd vyaqavyqrs sknanasiyn gdlstpfsts
361 inqtaatvgl rhrf
```

| 515 | 55 | YP_111684 | 90 |

```
   1 atgagaaac tgctctgtc taccctctg gtcgcgtgc tggcgcagc cgtgcagct
  61 cagctcaaa gcagcgtcac gcagtgccaa ctgtatcac cgtcgatcac ttatgtcac
 121 ggcaacgacg gcaaggccaa ctgatgggca ctgatcggcc gggcaaacct gcaaggcagc
 181 cgctgggcc tgaaggcgcc cgaggactc cgcgctcggc ggcgtcggcc tgaagcgca cttccagttg
 241 gaaaatggct tcaactcgaa tcggtctgca gcatgaccag gcaccacgc tgacctcgg gcaagcgcgc
 301 cagcgttcg tcggtctgcg tcggtcctgt gcatgacgcc taccacacgc tgacctcgg ccgcagtac
 361 gatccgctcg gtgacgtcg gtgacgtgca caacaacgac ttcgaagccc gcgtgaacaa cacgcgtcc
 421 gccaccccg cgcacgtata ccgtgttcgc cggcttccag gtcgaagccc gcatacaa caacgctcg
 481 tacacgtcgc ccgtgttcgc cggaccaagg ccagacgtgg tcggccgccg tcgcatacaa caacgccg
 541 gcgggtcgc cgggccaagg ccagacgtgg cttctacacg tcgaacccg cgatcacga cggtcgcgc
 601 atcggcgtcg gctacggta ccgcccgatc cgaacccgt ttcgaagccg cgatcaacag cggtcacacg
 661 tcgacgtgga gcgcggcc cgatcggcat cgcacaggtg gccgccagt acgtgtcgg ccggtcacg
 721 agccgaagt cgatcggcat gctacagcaa cgcgcaacc aagcggacg gctcctcgg ccttctcgtg
 781 gtccggctcg gctacagcca cgcggcccca gcctcgatcg gcatacacgg aggccacgcc agtaccacca
 841 accgaaggt acaacacggg gctacagcata ccgaaggcg acacagcgc agcaggacga gtaccacca
 901 ctcgaggctcg gctacgcata cacgaaggcg agcgccaaca cgcggacg agtaccacca
 961 gtgtcgatcg gcgggacta cgcggccgtc gccagcgtc aagccaagcg gatgcagcga cgcgcgtgcg
1021 taccagcacg cagccgcac gcacggcgt gcacgcgcaa gatgcagcga cggcagaga
1081 tcgatcggct cgatcgggcg cgtacggcgt gaacgctacg aagtcgcaag agatggtggc tctggcctg
1141 cgccacaagt tctaa
```

| 516 | 58 | YP_108401 | 91 |

```
   1 mkklalstls lallgaagaa qaqssvtlyg vidtsityvh gndgkannaw lmgsgnlqgs
  61 rwglkgtedl gaglkaifgl tadnyfgslf engfnsndgt lggkrmfgr qafvglqhdq ygtltlgrqy
 121 dplvdlvqpv tadnyfgslf atpgdvdnnd nslryrnntvk ytspvfagfq fealyfgsgi
 181 agspgggqtw saaaaynngp igvaagyfyt snpsptagsr stwsgssdai fdgainsgyt
 241 sakigiaqv agyvfgpvt vglgysnaqy kpdgfsgfss tekyntgrf vtyqatpall
 301 lglgyaytka sgtdakyhq vsigadyals krtdvylaga yqhasgtqrv dattqtaqa
 361 sigsygvngt ksqemvalgl rhkf
```

```
   1 tcaagcacac ccatcgccgc cgttcgtgaa cgcaccgggc cgcaccggc cccccgccca gcgcgcgata
  61 cagctgatc gaactgtctg agcgtcatga gccgcagatc cttcaggcga gcccgacct gcccgactc
 121 gaacgtctg gcgcagcagc cgccggcgt gcaccgcgtc gagatagctc cgccaccgcg tgtcgtaggc
 181 ccgctgggcg agcgcagcc acctgatcgc cgcggcgcgc cgcaccgtgct acgccgcgaa gcggcgcaag
 241 ctgccgtcg atctgatcgc atctgtatcg cgcatccgga cgccaccgcg gcatcgcgaa acgccgtctg
 301 gatcgcttc tcgtattcgg cgcccgccc cgaaatcgg cagatgctcg gcgtccgcca acgtccacac
 361 cgcacgattg agcgccaccg gcccgagaa gtcccgagga cgcgtgagc cgcgagccga cgtcggtcgt
 421 gctccgatc gcccagaaga cgcggcgcg gccacgcccg atgtcgcgt tgccggcgcg atctcgatcg
 481 gagccgatg cgcggggaga cgcccgctcg gatgccgtcg gcgccgctg agcagatccg acgcagcagcc
 541 gagccgctgc tggccctgcc cgatgtccgg cgaccacacg ccaccgcg cgaccggcg cgcgagccg cgatcggcg
 601 cggacacc cccgcaccg gcctcaagcg ccaccacg gctcaggc cgtgtcgcc cgaccggcg cgcgagcg
 661 cataggccg tcaagccgc tagagccgcg gaccagctac cgccgcgctg cgccgcg cgtacccggc
 721 cgccgcttc gacgcgcgc cgcacctccg aacgggctcg cgtcgagccg cgtcggtca cgtacgcgga
 781 cgctcgtg gagctcttc tcgtattcgg cgccgcgcgt cgcgcgcg cgcgagcgg cgcgagatt
 841 gagccgcgt cgcgatcagc cgccgcccg gccgcgccg cgccgtca cgccgagccg cgtgaacga
 901 cgcgacttg gcgatccgcg gccgcgcgcc cgatcaagccg tgatccgccc gcgcgcgccg agcggggtc
 961 ctcgcgagc gcgcgatcg agaggccctt cacccgccgg gctcctgcg gagcggga gcccgccgg
1021 gctcaagccg acactccgg gatacaccgg agccgtcgt gatcgcgcgg acacgcgcc ggtccgcgg
1081 gtaaagcg gtccctcgtg agcgcggct ggccgccctg gtccgagccg gtcggtcg
1141 cgcgaacgcg tagaagccg cgccgcgcc cgccgaggct gacagcagcg gtccagatcc gcggatagcc
1201 atgttcgcg acgccgct cgccagccg gccctcggt ggatccgccgg aatacgcg
1261 ccagtcgtcg agccgccg ggcgcgccgg cggccgcccg gccccgccgcc cggggccgccg cctgcgccgt
1321 catccgcggc
```

```
1381  cgaccaataa  tgccgccgca  cgggccggc   cgggcgctcg  tagggggcg   cgagcgtgca
1441  gcccgcgacg  agccgccg    cgaccgcgag  cgaccaggcc  cgcggcccgt  tcgccgccg
1501  cgctgccgcg  gccggccc    gccggccg    ggttcatc    atcgctttca  c

66

1  mkammkprar  rrgaraarrp  ngpraWPlav  aaalvagctl  apryerpaap  vpahywstat
  61  gapreagpaa  aggprampda  rrgdagrdar  darldddwray  ftdpalrali  daalamrdl
 121  riatlriqea  rglygvarad  rlpsidgslg  yertrlydpv  lreatssly   rasvgvsafe
 181  idlfgrvksl  sdaalaeyfa  taeaqrari   sliaevasay  vteralvdql  glaertlaar
 241  daayaltqrr  yaagtstaie  lrtaemlvas  araskaaler  ehtqaasalk  llagdfmtal
 301  padapaldal  avarvspgls  sdlleqrpdi  rgaegrlvaa  nanigaaraa  ffprialttd
 361  vgsysdafsg  lfsagssvwt  faprltlpif  aggrmnanld  vadarkhiav  aeyektiqta
 421  frevadalaa  rdgidaqlaa  qqavgadae   rlrlagrryd  sgvasyleli  daqrstfesg
 481  qelirlkqlr  ltnaitlyra  lgggwsragc  ggdgca

92

1  atgaagcgaa  aacatgcttt  gactgcactc  gcagtcgcgc  tgctcgccg   gggctgcacg
  61  ctcgcgcgca  gctacgagcg  tccgagccgg  cgcgttccc   ggccgacggc  cgccaggcgc
 121  gtctatgccg  cgcagccgg   cgcgcgcca   gatcctcgtc  cgcgaacgg   ccagagcgcc
 181  gtcgatatcg  gtgccgcga   gttcctcgtc  gatccgtgcc  tgcagcgget  gatcgagatc
 241  gcgctgaaga  acaaccgga   cctgcgtg    tcggtgctca  agtcgaggc   gtcgcgcg
 301  cagtcaga    tcacgcgcga  gggctctc    ccgacgtga   gcggccacgg  cacggcacg
 361  atccagcgca  cgccggccg   cgtgtcgatc  accggcagc   cgctcatctc  gcgaccac
 421  aagtcggcg   tctccggtc   gtgggagctc  gaccgttcg   gcccgtgca   gaggctgaag
 481  gatcaggcgc  tcggcaata   cttccgcacg  gcgcaggcgc  gcaaggccgc  ggagatctcg
 541  ctcgtcggca  agctcgccga  acacgcgga   tcagtactcg  agctgctgt   tctgctgcag
 601  gtcacgcaga  acacgcgca   gtcggcgcg   gtcgaccg    cgtccagcc   agaggtggt   cgagaccgcg
 661  gacaacggca  cggctcgga   gctcgactg   gcgcgacctg  cgccgcagg   cgctcaacgc  gtctgtcg
 721  ctcgagcc    agccgctgca  cgaccgtcc   cggcgatctg  tgccgtcaa   tgcccagaac
 781  ctgatcgatc  agccgctgc   acattccgc   cggtcgcg    tccgagcctgc  gccgacatc
 841  ctgccaccg   agaaacgct   aggagacgt   gcgcgccggg  aacgcgaaca  tcggcaccg  ccgacatc
 901  atgcaggccg  agatcctgct  caccagcgt   gcgtggtcg   ttcgcccga   acatcgcgct  gccgattctc
 961  ttcttcccga  cgggcacggc  gcgtgtcaagg  ggctccga   ccatcagcct  gccgatctc
1021  ctgtcaagg   cgggcacggc  gaacctgat   gaacctgat   ctcgcaccg   tgcagagacg  catcgagatc
1081  ggggtgggcc  agaacctgat  ccagagcgat  ctcgacacg   ctcgaccg    tgcagagagcg  catcgagatc
1141  gcgaactacg  agaaggcgat  ccagagcgcg  ctcgagcgca  tttccgagg   tgtccgacgg  gcttgccg
1201  cggccacgt   acgatcagca  gatccgggcg  ctcgagcgca  aacggtcg    acagcacg    gcagcagcc
1261  cgtcacgatc  tgtccgacct  cgctacagg   asydltklqf  dngsgseldi  rqaqtvveta
1321  accgggcaga  cggacctga   ttcgcgcag   cagcagttga  tcagcgcgc   gtcggtctg
1381  tgacgaacc   tcgtggacct  gtatccgcg   ctgggccg    ggtggtcga   gcggcggc
1441  gagagccgc   gccccgga    cgccgccg    gattacgca   aggcgcggc   cgcgcggcg
1501  gcgcgcgtgc  cggctcgtc   ggccgccg    ccggccggcg  gctga 517  55  53718454  YP_107440

67

1  mkrkhaltal  avallaagct  lapryerpaa  pvsgafpadg  vyaaqpgaap  garsangqaa
  61  vdigwreffv  dpclqrliei  alknnrdlrv  svlnveasra  qyqitraglf  ptlsgtgt
 121  iqrtpagvsi  tgpplisrty  nvgvsaswel  dlfgrvqslk  dqalaqyfat  aqarkaaeis
 181  lvasvadqyl  tllstddllq  vtqntlksar  asydltklqf  dngtgseldi  rqaqtvveta
 241  lasqaqara   raqalnalvl  ligepipddl  pagiplnaqm  lltdipaglp  sdlltrrpdi
 301  mqaeetlraa  nanigaaraa  ffpkisltsa  fgtaptlgg   lfkagtaaws  fapnialpif
 361  eggnianld   lahvqkriel  anyekaiqsa  taqtdlysaq  frevsdqlaa  rgtydqqiaa  lernehaqqr
 421  rydlsdlryr  ngvdsylsvl  taqtdlysaq  qqlisarlar  wtnlvdlyra  lgggwlerag
 481  etrpadapv   dygkaapaa   aavpaasasa  paag
```

| 518 | 19 | 53721406 | YP_110391 | 93 | 1 ttattccggc gagcccatca tcgactgctg atagtctga atgccgacct tgcgatcag |
| | | | | | 61 gtcgattgc gttcgagcc agcgcgatg ctccggta tcgcggaga ttcctcgaa |
| | | | | | 121 gattcgcgc gacacgtaat cacgcaccga ttcgcaataa gcgatggctt ccttgcacgt |
| | | | | | 181 ggccgcgat acctgttcga gctcaggtc ctgcaggtt cggcaggccg attcctcgg atttctcgc |
| | | | | | 241 gacgagcagc tgtgcagat tccgcggtct ctgcattcgc gatcgattcg tcgagcatga acacgcgtc |
| | | | | | 301 gatcagcag tccgcggtct cccagtgtt tgtacatccg gcatccgagt tgatcgt gctcgccgag |
| | | | | | 361 ttttcgagg cccagtgca ccccagtgc gaactgagt tcttcgaacg tgtccgcc tgatcgcgt |
| | | | | | 421 cagtcgttt ttcaactcg cgtcagata ttcgatgact tccgtgcgc cttgcat |

| 519 | 8.5 | 53721404 | YP_110389 | 68 | 1 mqgdkviey lnaqlkneit ainqyflhar mykhwglekl gkheydesig emkhadwle |
| | | | | | 61 rvfmldglpn lqdlhkllvg eeteeilkcd lkleqvsqat ckealayces vrdyvsreif |
| | | | | | 121 ekildddteh idwletqidl igkvgiqnyq qsmmgspe |

| | | | 94 | 1 tcaggccgcc ctgcgttcgt agaacctgac ggccgaccgt ggctcggc |
| | | | | 61 acggcaacgg ctcgacacaa cgccctgttc cgcatgatc tcggctcga ttccctcgca |
| | | | | 121 cctgccgcaca cagtggcca cccggagtc gaactggagt tcttcgaagt tgtccgccc |
| | | | | 181 ttccgagg gatgccgaa tcttccgatc gaaaacggac ttgcacacgc agacgatcat |

| | | | 53721404 | YP_110389 | 69 | 1 mivcvcksvs drkiraslae gvntfeelqf elgvatccgk ceetvreima egvcasrcg |
| | | | | | 61 aerpaavpva vtfyerkaa |

| 520 | 36 | 53722329 | YP_111314 | 95 | 1 tcacttgaaa cgatccctcg ggttgatgac cgcgtacagc agctcgacgc tcaggttgat |
| | | | | | 61 cagatgaac tccagcgaga acagcagcac gatcgctgg atcaccgggt agtcgcgcat |
| | | | | | 121 cgtcagcgca tcgacgagca ccgacccgaa agcgccccag ttgaacacgg cctcgacgac |
| | | | | | 181 gatcagccg ccgagcagga agcgaactg cagcccatc atcgtgacga ccgaatcat |
| | | | | | 241 cggttgcgc aaatcctcgt tcagccgtcg cgcacgcct tcgcgccgac |
| | | | | | 301 ggtcgcacg acccctcac cgagaacgac gcggcgtga agcggcgcat |
| | | | | | 361 cacggccacg acggccccgc ccgagcagct acgtagctct tccacgagcc |
| | | | | | 421 gtccgcacg accgcagcgc agccgagcc acctccatca gcacgagcc |
| | | | | | 481 gagcgcgaac gccggaaacg agatgccgcc gtcatgccga tgcggtccg |
| | | | | | 541 ccagcggttg cgccacacgg gcacacgcgat gccgagcgcc atgccgaaga gctcgccca |
| | | | | | 601 ggccatgctg acgacggtca gtcgtcagcgt gccgcagcct tctcggtcg |
| | | | | | 661 tacggcgcgg ttgtcgcgg tcgagacgcc gaagtcgccg tgcgcgttcc gcgcgaagaa |
| | | | | | 721 gctccgaac tgccccgca gggcttgtc gggccgcccc gagcgcgaga tcgggcgca cggagcgcac |
| | | | | | 781 ggtccgcg tccgcctcgg gggccgcccg gccgcgcg gatcgcccc gcagcaggtg |
| | | | | | 841 gacgaacagg aacaccagca ccgacgacgca cgccagcgcg ggcagcagcc cgaacagtcg |
| | | | | | 901 tttgaccaga aaattcagca t |

| | | | | | 70 | 1 mlnflvkrlf gliptlacva vlvflfvhll pgdparlaag peaadatval vradlgldkp |
| | | | | | 61 lpagfasffa riahgdfgvs trskrpvate igerfmptlt ltvvsmawat lfgmaigias |
| | | | | | 121 avwnrwpdr igmtlavsgi sfpafalgml lmevfsvklg wlpvvpdgsw ksyvrppsvt |
| | | | | | 181 gaavaavmar ftrasfvevl nedfvrtara kgvrepmvvl khclrnamip vvtmmglqfg |
| | | | | | 241 fliggsivve avfnwplglr llvdavtmrd ypviqaivll fslefilinl svdvlyavin |
| | | | | | 301 ptifrfk |

| 521 | 42 | 53721737 | YP_110722 | 96 | 1 atgaaaagc gcactgcggt cgcgatgacg tggcgccggt cgccaccgcg |
| | | | | | 61 cacgctcaga gcagcccaga gcgtacggc gcttacggg acggcatcga gtatcaaagc |
| | | | | | 121 agcagcacgt cgtcggctc gacgcgggc cggtccggcg cggtcggag gtcgacgggc |
| | | | | | 181 gtgtgccaga cagtcggtca ccgcggctt gggcttcagc acgccgaacg atctcggaag |
| | | | | | 241 gcgactttcc agcccgaatc agccgagcgg gggcttcagc gcagccgca gttcgcgggc |
| | | | | | 301 ggcatcttca cgccgccagc gtgggcagge gtactacgg ctgaccaaacc caccgtacgg |
| | | | | | 361 gcgggcccgc agtaccggc gtactacggc ctgctgtcgc cgtcgtcgc gacgacctga |
| | | | | | 421 ctcaccgggt atttcggggc gcatccggat gacatcgatt cggtcgagac cagtcaggc |

```
        481 acgaacaatt cgctcgtcta cctgtgccg  aagtctacg  gctccacgtt cgcgggctcg
        541 tatgcgttcg gcgacagcc  gggcagcgc  aacgccgct  ccacggag   cgcggcatc
        601 cagtacatga acggtccc   cgcaattcc  cgggcgttcc agcgcgtgaa caactcgac
        661 tcgggcgcg  gcgactgggg cgcaatcgca acgacgcga  acgcgcgcgc gcagaggcc
        721 gtgtcggcga tcaacacgga ctacaagacc gcgcaggcgc atctcggtag cgtcggtgacg
        781 gccgctatc  agtctcgtc  cgcatgggac cgcaggcgaa aggggatct  cgtactcgaa cgtcagtac
        841 atcccgggcg tgaactcgac agccgtggac gtccgcaaac tcggtggcg  gtctacggta gggcggtg
        901 ctgcacttca agccgtcgcg tcagtgggac tcgcggcg   gctacggta  cacgcgcgcg
        961 accagtcga  acggcattac gagccgccg  gcataccatc agctccacgct gtcagtgac
       1021 tacagcctgt cgaagcgcac ggggctgtac gcggcggaag cgtatcacgc cgcgaacggc
       1081 aagacgctcg cgggcggcaa tctcgatcga gatcatcgac gccgacgacgt cggcttcaac
       1141 acgtcgccgt cgtcgcaggtg cagccaggtg gcgcctgat  tcggctgat  ccaccgtttc
       1201 tga 71    1 mkkrtavamt aaglaavata haqssvtlyg ivdnglayqs sstlgsttg  grsavkmstg
         61 vwagsrfglk gsedlgggsk aifqlesgfs tangtcgfag giftqawvg  ltnptygtlt
        121 agrytayyt  llespyspttw ltgyfgahpg didsldtsyr tnnslvylsp kfygftfggs
        181 yafggqpgsv nagstwsagi qymngplgia aafqrvnnst sgggdwgans ttsnggaqta
        241 vsainngykt aqaqgrvavt agyqfssawd isvsysnvqy ipgvnstfrn taifntagav
        301 lhfkpsaqwd faggyaytra qyhqftlsqy yslskrtgly aveayqrang
        361 ktlaggkiid atasigdgfn tspssrsqv  gvgvlihrf 97    1 atgaaaacct tcccgttgtc cgctcgtgcc accggccgtg cgtcgcgcgt cgctccgcgc
         61 cagtcgcgga atgtccgga  ctattcggc  ctcaagagcg acaaggcgat cgctcccgcg
        121 gcgcagttcg aaagcgcgcg gagcctgccc gcgcaggcc  gccaatgcc  gtcgctcgac
        181 tgggcgaacc agttcggcga tccgcaattg ccgacgaggc tctcgaggcc gtcgaaggc
        241 aatccgacga tcgccgacgg cgaaggccgc atcgcgaagg tgctgagcgc ccctgactgc
        301 tcgcgctcga cgctcgtcca cgctttccc  gcaggtcgac gcggagtact cgtactcgta catcgagtcg
        361 tcgggcaacg ccctttcc   gccccgccga ggcaggcagt gagtacgga  ggtacacgca gaacaacgcg
        421 ctcgcgagcg cgtcgtggga gtcgatctg  gtcgcgaaga accgcgcgcg cctgaatgcg
        481 gccgtcgcg  aggaaaggc  cgcgaggcc  cgcgaagcc  aggccgcgct gacgctccgg
        541 agtcggtcg  cagcacgta  caactcgac  gacaagatca cgacgccgcg cgtgcggcgg
        601 gggcgcgaga tctcgaaccg gcaagccc   gccacgatca ccgacgccgg acatcgcccc
        661 ggcctcgaca cgaactcga  cgaaccgcga ccagatcacg aacctccgct atcagctcgc cgcgctgcgt
        721 acgtcgtccg atctccacgg gtcaaggtc  gcgatccgat gtcgagggc  tgctgagccg gggcgcgcg
        781 ggcaaaggtc cggaccgcgg gcgagaagcc gccgcccggg gcgatc     cgacgaggc  tcgtcgcc
        841 gtcgcgctgc cggagaacct cggagcgat  gccgcccat  gcgacgcc   ccgccccgga tctcgtcgcc
        901 gcgcctgc   agtcgaagc  gcgatgcac  gcgatgcac  gacgtgaagg aagcgaaagc cgagttcttt
        961 ccgacacatca acctcccggc gccagcccg  ggcttcgc   ttcgacgcgt ccgattcctg
       1021 aacttcgga  gcgcgagc   gcgcgagcc  cgcgatcgga cgcgatcc   accgtcgcgat cttcgacgg
       1081 ggcggccgc  gcgcgcaatt gaaggccgcc tacgcgcc   tcgatctgtc ggtcgcgcaac
       1141 tacaaccaga cgctcatcaa cgctcgtgaa gcgctgaac  cgcagtcga  cgcagatcgc gtcgattcgc
       1201 tcgtcgaca  cgcaaatggg ccagagcag  caaggcggg  cgacgcggg  atgcgcctac gccaacgcg
       1261 gagtcgcgg  tgatccgta  gcgcagcgc  tgtccggcgc tgtgccgc   agtttgcaggt gtcgacgcg
       1321 gacagtcgg  gcgcgcatt  gaaggcgcc  gcagcagcgc  tgaagatgc  ggcgcggaac cgcgcgccga
       1381 ctgcagatcg gcctcgtgaa cgcctcgcgg ggcgtttcg  acgcggcg   cacgcggctc
       1441 gcccagtccg ccccgcgctc ggcccggccc gcgccggcg  gcgcacgcat gcactga 72    1 mktfplsacr tavavaaal  alagcanyfg lksdkalpa  aqfesearsl p aggqwpsld
         61 wanqfgdpql pklideaeleg nptiaqaqar iakassyes  srstllpkad akyswtrely
        121 sgnalfpppy ggqwysenna lasawseldl wgknarlna  aysqekaaea dlqqarvtla
        181 tsvartynql aqlyalrdia greisnrqtv gkitdgrvga gldtnverqt argniatsqs
        241 tlsdldgqit nvryqlaall gkgpdrglqi aapvlsagga valpenlpad lvsrrpdlva
```

522  56  53719527  YP_108513

-continued

```
       301  arwqveaamh dvkeakaeff pdinlaagfg fdafgwgrfl nfaarqaqfg paihlpifdg
       361  galraqlkgr yadfdlsvan ynqtlinaln dvatqvasir svdtqmgdaq raidastray
       421  elaviryKag lspolqvlna dsnrlaeqt vtnlkmrrrd lqiglvkalg ggfdaagtrl
       481  aapapasapa apaqhasn 523  85  53720164  YP_109150  98
         1  tcacagcgac catttcaact ctccataaaa agtgcggccc ggataaggat ggaacacgta
        61  gtagcgggcga tcggtcacgt tgtcgatgcc gaaccacgca agccagtgcc gatcgaacg
       121  atagcgcgcc ttcaggtcga cgaccatgaa cggccggtg cgcccgtata cgcccggatt
       181  cacgtcgctg tgtcgagcg cgttgtactg ccgcccgaa tagccgaacgc cgacgtcgt
       241  catccaatgc tcgtcgaagc gtacgacg agttcgatt ggccaggttc gcggcatcc gcgaatccg
       301  cggcagcgc ttccgtcga cttccgagc cttgacgcg acgtcctgc gcgattcgt
       361  gcgacaacg ccgcgcacc cgcgcgtc gcacggtc attgcagca tcgtcgag ccgagaacgc
       421  gagctcgacg ccgcgcacc tgtagatcga gcaggtcaca agtcgtgt agtcgacgc
       481  gccggcaagc gtggtctggc cgtccgctc gcggtgaaa tcccagtcga acacgctcgc
       541  gcgacgacg cgaagcga ttccggtca tgttgacgat ggcggtgttc cctgaacag
       601  cggccagca ttcgggtcga tgttgacgt cggtgttc tgatcgtgc cctgaacag
       661  ctcggcgacc gtccggaagc gctcgaccgt cgcgaacgc aaccgcagg gccacggct
       721  ggccggctgc cattcgagcg agagctcgg cgcgagctc gcatccag gtccgcgcg gtccgtacg
       781  gcccggagtc gcggtccgcg cggtccgagc agccgggcc gccgcgtat gcgctccag catacacgcg
       841  caggccagac gtccgcagcc gtccgcagc gtcccgcgac agccgccgc gtccgcaccg cgtttgcca
       901  ctgcgtcgcc gtgtccgcc gataccgtt cacgccgtc cacgccgtc gaaatacgta agccgaacga
       961  gtcggccgtg ttgtagctcg cgtcgcgcag cgggcgactc cgttgcggag tcgaagtggt gccagccggt
      1021  aaacggtgc ccgcgcacgt tgcccgcgc tgccgggcc tgccccag gccgtgcag gtccgcgga
      1081  cggcagcgcca tggaacacgg agccgggcac tgcccgcgc gcggggccgg gcggttcca
      1141  cgccgtgtcgc agccgtgtcc cggacactcc gtaggcggac ccgtacagc cgcccggtg gcttctcct gcctgccgtg
      1201  gccgacgcg agcgccgcgt cgagccgag cgagcgccg cgagttcgc gtagtcgcc gcgggaacg aacgccggt
      1261  ctggccaac acggccccg gggttgcgc caggagcgtg cgcctgcgt gcccgaacg tccgggtacg
      1321  gcctacacc ggttgcgc ggcagcgtt ggcctgcgc gtcgcacgtg tgccgaacg tcgttagcg cctagccgaa
      1381  atctccag ggctggtca gcgacgac gtccgcgt cgcgctcgt aatcctga cgatgtgcg
      1441  gcgaacgtc tcgttgact tcgttgact tgtccgag ggccccgc gcctgcatc accgcacg gtccgccag
      1501  cggcggccg aacgcccgt cgcgctcgt gtatcggct gtcgcatc ggctggcgt cgtcctcgag
      1561  cctcggatcg aacgcgcct accagaaacg accgaagc gatagcgct gcgggcgga
      1621  ccggccgag gacaggcgca cggaccaaca tcgacacga tcgcacgtc ggcgcgcgag
      1681  gtgattgcccg cgaagtgct cggcgaagcc gtagcgtcg cgatagcgt ggtgaagaa
      1741  ctgctcgac acgaccgcct cgagccgcgt cggctgctg cgatagcct ggatatct gcacgtcga
      1801  gcaatcgcg ttgcccggt agagccgga aaacggccg tacagcacgt ccacgcgtgc
      1861  gatgcaagcc ggctggatca cgcaacagg cgggatac ggtcactccc aatacgcag accgagcag
      1921  attggacaagc aggatgcct cgcatagaac gagtccgcg cgtcctcgca gctcattga
      1981  gtctcggccg gcaaactg aattggtcgt gccgatgt cacgtccggcga cgcgcgca ccatcaggt
      2041  cgcgcgtac ttgagcgct cttcggcgt cacgtccgt tgcaatcga tctgtcgcg
      2101  ctgagcgcg gacagcgcg ggcagcgg ggcagcgc gccagctc ggcctgac
      2161  cttgacgta tccaagtt tcccgatc ggtcactcc ccggcgtga
      2221  atcgcaagcc acggcacg cgtgccggcg gcgacgac gccacgag cgccgttga
      2281  ggccaggcc gcgcgagc gctcgcgagc gcctgcgc gccagccag gcaagttgat gaaacat 73       1  mfhqlaapga rrrlaaacaa alawpaahaa staaavpads tpaaaaemta sgktldtvkv
        61  taqraafapd apvvealtr eqidshvnvt tedalkyapn lmvrrryigd rnsvfagrdf
       121  nelqsargliv yadgillsnl lgssysyppr wsliqpddia rvdvlygpfs alypgnaigs
       181  tvqitthkpq rleasystqf ftqryrdgyg fadsfggnhq sariadrvgr fwyalsldrl
```

```
241 endsqpmqya spngafdprl gapvpvtgav sdignpngrp tivaqtier teqlnetlrf
301 gyaftdhvda tvelghwenh yrqhgdtflr daagnpvygg nvsfggrnyt vspgafapqt
361 gdqenwlygl gldarlaagw klsataasaye vsrdvlrsas gappawdgg pgtvfhgdgt
421 gwrtvdlrae spdvrghrfs fgyhfdtyfl rnatyntadw qnavpttlvn ryrgntrtqa
481 lyaqdawrva pgwlatlglr yerwdaygge lggatlgy aergatafsp klslewqpas
541 awrirlsfat gtrfptvael fggtismnai vnmnplqpe kaidwdftae rdvfgvvra
601 svfgsdlrns iysqttlaga stytnvsnvd rvrvrgvela fsgqdvalkg ldvdanvsat
661 naqtladaan pnyvgarwpr iprmranlla syrfdehwmt svgvrysgrq ynaldnsdvn
721 pgvygtssf mvvdlkaryr fdrhwlasfg idnvtdrry vfhpypgrtf ygelkws1

1 tcagaatgtc gtcgcatcc gctgcccg gctgcccg cctgcggcg cgatgttgcg
    61 caccacggag ctcgcggagg ggatgtcctg gtcgtcagg ttgtcgcag gcgagataggc
   121 gagccagttc gtcgcccga cgcaacctt gtaggtgagc acgacgcca gcgacgtta
   181 gcgtcgagtc gcagatcgt gtcggcac gcagctgc agcgccgcg agcgtgagtg
   241 cgcggcgcca cgaacgggc gtagccga ccgtgccg atcggccgcg agcgccgcg gcgggcgc
   301 gatccgggc agcggctgc agcgtccga gtgccgcg gaacgcgc cacctgcgt cggccgcag
   361 ctcgagatcg acggatgcc tccgcggca gccgcgcta gacgcgcg cgcgcctg cgagctgac
   421 gcgtagaac tccgcggca gagccgcgt gtgccgcg gagcgtcg gtgcgtat cggcaggta
   481 cgggccacg ggcacgcgt gtcgtcgac gagccgtcg gagccgtcg ttcgaaccgc tcgcatagcg
   541 gttccgcagg cggctgtga acacgccgt tcgcctcgat ttccttatgc tcgaacttg cgtagccga
   601 cagccgtga tcgtcgaca ccgcctctc cttctcggca gtagccga tcggccggc cgatcaggta
   661 ctgccccgtc gcccgtgcg ggccgtacga cgcgggcgcg gtacgctgc cgggcgcg gcgccgtc
   721 cgtcgacgac acgtgcccg cagcgacca ccgaacttgt agctgataca gctgataca gtcgccgtt
   781 cgacacgctg ccccaattga aatcgctcg cgcgcgaag ccgaacttgt cgaacttgt gtcgccgtt
   841 cgcgccgca tcgagccga cgtgctcgat gcgccgcg gcgacgcg tcagccagt tcagccgag
   901 ggtcgcctgc cactgccga ggcgaacag gtctgccg cgagccagt tggtaggc cgagcgcc
   961 gagcgcctg gagcgccctg ccccgacg ggagaacgt gtcctgcg acctgccg gcagccagt agttcgatc
  1021 ttcgaaggg tacgatgcc gcgtagcc gtgtacgag gcctcgag cgcccgcgc cgccgcgc
  1081 aaacctcgtg ccctcacgc gcctctgat tcccttatgc cagctgccg tacgccgcg tggcctcc
  1141 gtcgaatttc agctgccga aacggccgc gcgccgcga acccgacga aacccgacg cagccgcgc
  1201 gcgtccctgc gcatccgaa gcgccccgt ggttccggg gtccgcacc gtgtacgag cgtcgattc
  1261 gtagccgtc tacgatggc gcgtagcc gcgtgttgg cagcgtccg tacgccgcg cgcccgcgc
  1321 gcgcgctaa cgggccgg ccggtccgg cgctgttcgg cgacctgc tacgccgcg tggcttctc
  1381 gcgtcgagc gcgcgctgc gcgccgaatg cgcccgaatg cgcatggcc ggaatccga gcgccgcgt
  1441 ctcgcggcg aacgccgga gatgaaacgc gaagccggcg ttgccgcct cgacgagcg cgacgagcc
  1501 cgcgccgca cgcgccatgt tcgcgccga gcaccgcg gcagccgcg tcgacgcgg ccgagacgc
  1561 cgtgatcgct cgcgcggaa ccggttgtc gatcgttg acgaccgcg gtcgcgca gcgaatcggt
  1621 gccgcgtac agcaacgcg cggaaacgcg cggaagatg caccactcg gacactcga cgtcagcgg
  1681 atcctcggc accctgcgat cgtaggacag cgcgagcgg cgtacagcgg cgtacgcgg cgacgcgtt
  1741 ctgcaggagg cggatgcgat cgcccgccat cccggggatg atcgagcgg cgacgagcgg
  1801 gccatggtc cgctgtgaca cgccgccga cgccgccga gtcgccga gcgaatcggt
  1861 gcggcgcagc gtcagcgct gtcagcgga cgccgccga cgccgccga gccgccgg gcgacgacg
  1921 gccgagcgg tcgcggtca cggggcgg cgaagatcg cgccgagcgc cgtcgcggcg gcccgcgcga
  1981 tcgggccctg gcgggccgg cgccccgcg gcccgctc gccatgcgcg aggtcgcgg cgacagcag
  2041 cgacaaggg gcgccgata gagccgaaag cgacgcggg cgccgccgg cgtcgtggt catccat 1 mddhrriapp farrlhplsl llaaslahge tgappaerrs dappatalap ifvtanplga
    61 salsptasl sgdaltirrt dslgdtingl pgvsttygp lvgrpiirgm dgdrirlqn
   121 gvaaydassl sydhavpqdp lsverieivr gpaallyggn avgvvntid nripreaitg
   181 vsgaldasyg gannaragea lveggngrfa fhldafgret dalripghah sarqraldge
   241 dasepygklp nsdgrrygga aggsytwadg yvgasysgye snygsvaetd arlqmrqerv
   301 alasevrnlr gpfsqlktdf gytnyqhkei edgvtgttfr nhgyearvea rhrklgpfeg
   361 algvvgqnt fsalggeala ptrtrtsval fgleqvatd alkisagari ehvrldpsan
```

-continued

```
      421 gddkfgfars rdfnagvsa galyqlapaw slagnvsyte raptfyelya nphgatgqy
      481 ligrpdaqke kaystdlalr yasgpnrgsi gvfysrlrny laeydtgrlv dddgvpvapg
      541 addalreavy rgvraefygv elegrwrafe rrghrvdlel sadytharna dtgeplpria
      601 plratlaady gypfgaraq lthawaqhrv pehdlatdgy tslgvvltyk lrvgatnwla
      661 ylrgdnltnq diryassvvr niapqggrsv sigmrttf 525   43   53718452  YP_107438  100

1 atggcgtcg aacgggtcc ataccgtta atcactgtcg cgtttcctg
       61 gccgcgtgcg gaaaaaaga atcggctccg cccctcaaa cgccgaagt cggcgtcgtc
      121 acgtccagc cgcagccgt gccgtcgtc tccgaactgc cgggcgtat gagcgctat
      181 ctgtcgcgc agtgcgcg acggcgtgt ggcatcgtgt ggccgcgcga gtcacggaa
      241 ggcagcgacg tcaaggccgg tcaagctg tacaagatcg atccggcacc ctatatcgcg
      301 caattgaaca aggcgaaggc gacgctccgc aaggcctcgc cagtcggaaa gaccagaac
      361 gcgctcgtcg cgcgctacaa gtgtcgtc gccgaaacg cggtcagcaa gcagcagtac
      421 gacatgcgg tggccgca aggcaggcg gccgcgacg tggcgcggg caaggcccc
      481 gtcgagaccg cgcagatcaa cctcggctat acgatgtcg tctcgccgat cacggccgc
      541 gtcgcatct cgccgccgcg gccgggccg tacgcgggg tctgccagc gacctgatg
      601 tcgaccgtcc agcagctcga tccggtctca gtcgatctca cgcagatctc cctgacggg
      661 ctgaagctgc gccaggacat gcaggacat ccagagcggg cgcatcaaga cggaaggccc gggcgcggcg
      721 aaggtcacgc tgattctcga ggacgcacca ccgtacccgg agcgggcaa gctcagttc
      781 agcgatgtca cggtcgacca gagcgacggg tcggtcacga tcccgcgat cttccgaaac
      841 aagcagcgcg tgctcgtgcc ggcatgtcc gtcaccgcgc gtgcgccgc gcatcgaaga gggcgtcaac
      901 gagaacgcgt tcctcgtcc gcagatcggc gcaggtc gagccaagg tgctggtcac gggcgcacg
      961 gcgatgatcg tcacgcgaca aggggtggt cgcaggtc gggcaggtc tgctggtcac gatcgtgcag
     1021 cagggccaga actggcgtgt cgagagccgg cgcgacaccg gcgacctca actgccggcc
     1081 ggcatcgaca aggcgcgcc gcgtcggg ggcaaggtc ccggccgcc cgccgcggcc
     1141 gcggcgggcc gcgcgcccg ggcgggcgg tgcgccgcc cgccgggct cgccgcggcg gagcgcggcg
     1201 gcgcgcggg cccgtcggg cccgtcggg tgccgcccg tcgacgcgtg cgccgcgtc gacgcggcaa
     1261 taa 1 mrvervpyrl itvataavfl aacgktesap ppqtpevgvv tvqpgpvpvv selpgrtsay
     61 lvaqrvravrd givlrrefte gsdvkaggrl ykidpapyia ginsakatla kaqanlatqn
    121 alvarykvlv aanavskqqy ddavaaqgqa aadvgagkaa veteqinlgy tdvvspitgr
    181 vgisqvtpga yvqasqatlm stvqqldpvy vdltqsldg lklrqdiqsg riktegpgaa
    241 kvtliledgk pypergkqf sdvtvdqtg svtiraifpn kqrvllpgmf vrarieegvn
    301 enaflvpqig vthdpkgqai amivdgkgkv eprvltvgt qqpnwvvesg lqagdrvivq
    361 gidkvrpgmt vkaaeaqlpa aaagasgaap aggspaqaaa asaaaassaq Bm10229-600

ID  MW   Protein GI# Protein Locus#  SEQ ID NO:                 Sequence 601 81   124386268  YP_001026287      121
        1 ttaccagttg tatttcgcgg tcgcgatcac ggtgccgctg ttgccgtaca tgcacaccgc
       61 atccgactgc cagccggcca cgtgaacagg gttgaacagg ttgtcgcgt tgagcgcgaa
      121 acgcagttg gagccagtcg agtgcagcg ctcggcgaac agcgtgtagc tcgtcaccgt
      181 gagccaattg tcgacccccg cgcagccgcg tgtccacgt gctcatgag cacacgcgcc
      241 gaagcccgtg agagccctga acgtcgacgg gccacctgtt cagccgtg tcgtccgcc cgatcggcg
      301 cggcagggc tagaccctga acgtcgacgg gccacctgtt cagccgtg tcgtccgcc cgatcggcg
      361 gctccgtcg acccgaccg tgtcgatcac gcacctgcg cgacaggt tgcacacgg
      421 gcctcgtcg accccatccg tgtgccgcg cgacctcgt acgaacgtgc gcccggcgg tgcaccccg
      481 gtcgttcgga ttgtctcaccg gagcccgcgc cgacgttcgt tggtgacgg ccgatccag gccgtcag
      541 catcaggttc ttgccgggc agccacgcc cgtccaagcc caggccgatc tgcgatgga ggcctttggt
      601 cggcttcgcg aagcccgcga tacggcgga gtgtccagc tgcgaatac gtgcgcca cgacgtcga
      661 atgatctgagg tacgccgga tacggcgga gccctgagtc tgcgagatac gtgaggccca cgcccgct
```

-continued

```
 721 gaacgcgtgg tgttctgcc tgaagtcgc cgagctgcga cgcgttgcg atgcgtcct gcaacgtgcg
 781 cgtccagtcc tgccggccgc cgaatgcgt tcagccgtga cttccacttga cgccacttga tctaggtctg
 841 cacgtacagg ccgaatgcgt tcgggcggaa ccgcggcgt cttccgcacg gtgccgacg cgttaggccc
 901 gctgaagatg tcgacggaa tcggcggcgg cggggcgcgg ctggggcgg tacaggtca ggctaggccc
 961 cttccgagc cattcgtat cgtcgtcgt tcgtgaattc cgcctgccc tagtcgaagc cgtcgaacgc
1021 cgtgtgcgaa agaggcccg tctgtgcgta ggcctgccc cgcctgcga tggtgtcga cgtcgaagcg
1081 gtcgtagttg aactggaaca gcccgccgt agacggaca gtcgcgagc gtcgccatcg tcggtctgc
1141 gtcctgcgc agcgtccaca ccgggtcag cttgtcgcgg cttgtgtcg aacgatagc cgagcgcac
1201 ctgtccttg cgtaatggt cgaagtcgc atcgccgtg tacaggtcgt ccagatcgt
1261 gcctccgga ttcggcagca cgtccgcg gaacgcagg aagttgctcg acgtcccc
1321 ccagcctgc aggacgtgg cggcgaggt cgacgccggc tccgcgtcg gctgcattt
1381 gagcgacggc gcaacgaca cgcgctggtc cgcgctggc ccgctgcgc gttgcgtc
1441 gcgccgacg ccgaacgatc gtacgacag cgtgcgtcc ttgccgatcg tgtcgcgat
1501 gtcgaacatc agtcgcttgc gcgtagtc gccgacctgc agccgaagc cggatgcg
1561 ctcgccgttc gcgacgttgc tctgcacgtc gacgatcgc cgggatcg cctcccgta
1621 cagcaccgac gtcggccgc gcagccggg cgagcctcg gacgatcg gatcgacg
1681 ccagctcgac agttcgacg tgttcgcac accagtccga cctgcagccg cgtcgcgt
1741 gaagccgcgc agcgcggct agcgcggt accagtccga acggtgtcc gacccgtagc cgagaagcc
1801 cggaatgtag cggaacgct cgcgccgggt gatctcgatgc ggtcgcgg cgtgcctga tctgctgcc
1861 ggtgacgacg ttgatcgtct gtgaatctc gatgatcgg gtatccgtt tcgtccgt
1921 catgtcgcgc cgcgacga gcgcgcgc tctgccttc gcctgccgc tcgctgccg ccgacaccga
1981 gatcgcggge aactgcgcg cccgcgtae ccgcgcggt gtcttgcgcc gcccggcg ccggctgcg
2041 ctcgccgcc cgcgcaccgg ccgcgatcg cacgcacg cagcgcgtt cgtcgtgt tctccgtg
2101 cgccacgccg cgccgacg gcccagtccg cacgcgggc gcgagggcg
2161 ctccaagttg caaagcggc
2221 caccttcat 1 mkvrpsrplc nleqrkmewa tstvrraiaa gvafyaaaag haqaqaapg adarqpggea
 61 kadtaaggtl paisysgaae rdasvglvar rsmtgtktdt plielpqtin vvtaqqieat
121 gatdinqafr yipgfssygs dnrsdwyaal rgftptvfvd glqvpntinl sswrvdpymi
181 dsiavlrgpt svlygqdpg aidvdvqskla ngerirelgv qvgnyarkql mfdigdtigk
241 dgtlsyrivg vgrdgnaqtg pladqrvsfa pslkwqpnad tsltlaatyl qdwgdtssnf
301 lpsrgtvlpn pngtisddly tadanifdhyr tadanifdhyr ehklnpvwtl rqnvrwmhls
361 ldasvyggg lddadptmat mtryaglfqf nysrfdvdnq aqakfttgpl shtllfgfdy
421 nrqtttdsew lakgpslnly rpvytpipsd ifsgpnasrt dtkttlnafg lyvgdqikwr
481 rwvltlggrq dwtrtsqddi anaasfrqnd hafsgrvglt ylgdyglapy lsystsfnpq
541 iglklagggl atpkgrqle aglrwqppgk nlmlnaavyq inqtnvamsn pndptssftv
601 qvgevrsrgv elsavgnlsr elsviaayvy qdvknvrand nsltvpsytl fdaalhyelr nwrfalnatn
661 adwtwrtgpl tgfgvgagvr ymsaaagavd
721 lfnrryvagc qsdavcmygn qrtviataky nw 602   55 124383029 YP_001025939

1 atgaacaaga ccaacatcaa cgaacgcatc gcgcgcgtcg cgaagatcgc ggcggcgagc
 61 ggttgctcg ccgcgtgct caaggaagcg cgcgactacg ccgactaccg cgcggccgat
121 gtccgacgc cccggcgtt ccggcgccgt ccggcgcgcg cggcgaagcg cgcggccggc
181 agtggaagc ccgcgacg gcgcgcacg gcgcgcgcg gcgcatcgg gcgatgtcg gccgtattc
241 ggccgatccg tgtccgatgc gtcgcagcg gcgcgaacg ggcgcgcttg ccgcgaacca gaactcgaag
301 gcgcggcgg ccgcgggcgg gcgcgatcga ggccgcgggt ggcgatcga ggcgacccc ctcgcagtgg
361 ttcccgcaag cgggcaag ccggcagg cttccgggcg acgcagcctc ggctcgcgtc gggccgcag
421 ttccgacgag cggcgcgaag cggcacctgt cccgacgaac ggccgcacgc tcgaagcgg ggcgacggcg
481 tcgtacgaag aagcgcagag cggcggcgc gccgcctc gcgccgctcg cgtcagctcg gaagtcgcg
541 gaagcgcaga cggaactact tccggcgcag gccaggccc cggcgcgc gttccgcag gccgacgtcg
601 cagactact tcgagctgcg ccggccgcgc caagctgtg cctgaccag ctcgacgagg gtcacccggtc
661 ggctgccgcg aggaggcgct gggctgcgct gccgcgagg aggaggct
```

```
       721 gagctcgacg tgtcgcgccg gaagaacgaa ctgggaaccg cgcggtgggc
       781 gtcgcgcggc ggccgcgcgc atcggcgcat tcctgctcgg caaggcgccc
       841 gcggatttct cgttcagcga ggccgcgggc cggccgatg cgatcacg
       901 ctgccgtcgg cattgctcga ggccgggccg gacatccgg gcgcgaagct cgaccgcacc
       961 gcccgaaacg cgccgttcg gctatgaggc ggcaactgt tcctggtc gagccgcacg
      1021 ggccgcttcg gcgtcgtcgc ggcgcgcgcg ggcgccgcg ctcaacgtgc cgatcttcga cggggcgcg
      1081 ttcctgctcg gcgtcgtcgc ggcgcgcgcg ggcgccgcg ctcaacgtgc cgatcttcga cggggcgcg
      1141 cgcagccgcg ggtcgtcgcc ggcgcgcgcg gggcgcgcg aagtatgacg aggaagtgc gaactaccg
      1201 cagcaggtgc tgtcgcgtt ccgcgaagtg gaggacaaac ttgccgatct ggtctgtct
      1261 gacgatcaga tccgcggca aagcgacgc gtcaacgcgt cgcggcgcgc ggcgaagtg
      1321 tcgccgcacgc agtatcagga aatcgaact gcaatcctcg agtgatcga cagcgagcgc
      1381 tcggtcgctcg aatcgaact gcaatcgaac cagtcgacg agtcgacg ggtatcgacg
      1441 gtcaacctga ttccgcgct cggccggcgg cgcgggcgc atgcggccgc cggctccgc
      1501 gagccgggca gcaggacgt cgcggccgt tggggagcg tga 102
         1 mnktnineri arvakiaaas gllvallaac avgpdyrrpd vatpaafkea palapgeqag
        61 twkaaepada ahrgewrvf gdpvldalet qalaanqnlk aaaarveqar aattraarsqw
       121 fpqrgvgfgp treglsasq fqpggsgptn atlwraggtv syeadlfgrv gnveasrad
       181 eaqgqalfrs vqlalqadva qnyfelrrld sdqllyrrtv qrrfaegdis
       241 eldvsrakne latqadavg varrraaseh alailgkap adfsfsetpi apvavrvpag
       301 lpsallerrp diaaaeramm anarigla sayfpkldit gafgyeaat1 gnliflwssrt
       361 fligpfagta ltlpifdggr rsagvaqara kydeevanyr qqvivafrev ednladir11
       421 dddiraqsda vnasrraakl srtqygegav syldvidser svlesqlqsn qltgtqavst
       481 vnlliralggg wgsdaalger epgkqdvaar 123
         1 ttggcgcggc ggccgcttcg cgccgcgctg ttcggggcct tcgccggcgc tgccgccgcc
        61 gcccgcatcc cggcccccgc gtccgaaccc gtccgcagtg cggccgccgc cgatccgccc
       121 gccgccatcc cactgctgcc gatcaccgac accaccgtc gacgtcacg cagcgacgcc
       181 gaccgccgg cgagcctcga cgccgatct gtcgatcagc cagtcgatcc gacgcgtcc
       241 cgaccccggc caagcgtatc gcgatcgagc gcgcgcgc gatcagacc acgcgacgc cgcgtacccg
       301 aacatcaagg acgcgtttc gtacgactgc cggcacccg ggcgtcacg tgcgcgcac catccggcc
       361 ctccgaaacg atcggctgct gcgaaactgt gcggcgatcc ggctccggc cgccgtttcg
       421 ctcgaaggca acccggtgct gctgatgaa acgaccag agcgacatcg gcgatcaat
       481 ttcggcccgc tcggaagcgg ccgcgcccgt gtccgggctg taccgacgct cttcagtatc
       541 gagatcctgc gggtcgcgc ccgcgatcca tgcgcagcg acgccctgac ggcgccgtc
       601 aacttcatca cgaaagatcg cgaactccg ctgtcgatcc atcgaaaaaa gacctattc
       661 tcgttccgga cgaactcg caagacgtc cgcagcgtcg cgaacgaccg gacggcgcg
       721 ggccggcaacg atccgtcga gcgatgtga gcgatgcag acgcgcgca cgaggccg ccacgaactc
       781 gacacgcacg cgagcctacg acgcgcgc cgacggcgc cgaccgcgc cgaccgcgc tcctcaggat
       841 gtctacaagg aatcgcgtct gggccaagcg atcgacagcg agtcgacaa ggcgatcaat
       901 aagccgccgg cgaaaacgcg cgaaccactc cagcgagcgg cggcggcgg atcgtgcc gccgagacg
       961 cggcccgcac cgccggccgt accccaagag cgccacagtc ctgctgacg gggatcgtt cccgaacaag
      1021 gactacgatt tcgcgacgg cgcccgccag gggcctccga ctcgctgc ggccacgcgt gcttcaatcg
      1081 tatcaggagt cacccgatca cgaaaacgcg tcgagacgc ttcggacgcg gctgcgggg gatcggttc
      1141 cgttccgcg cgaaccactca cggccgatc cagacccgt cgggcgtcg ttcgacggc gtccgagcg
      1201 ggcttccgga ccccggcgt gcacgagat gggcacagtc ctgctgacg gctacccgg cagcatcgac
      1261 cgatcaaga gccgacta cccgcgtc gggcgtcg gcgatcgt tgccgatca gatcgcttc
      1321 tatcgaggat cgccgatgt gggcgccga gccgaca cccgcgtc gggcgtcg gcgatcgt tgccgatca gatcgcttc
      1381 gcgatcccg acaccagga ctcgcgtcg gggcgtcg ttcgagcgc atcggtcag cccgagcgg
      1441 cgttccgcg tgtcaccgg cagacgtc caagacgtc cagacgagc agtcgagc gtcccgcgc
      1501 gtcgatcgc tctatgagc cgccccga gtcgcccga ctgattcct aacagttct acgcacgtg tgcgcacg
      1561 tttcgcacgc cgacccgcgg gcaatccgaa ctgaagcc cagtcgaac ctgaagcgc gacagcgagc
      1621 acatcgatcg gcaatccgaa cctgaagcc cagtcgaac gagacgagcg acacgctcga agggcctg
```

```
1681  cgggcacgcg  tcggcacgcg  ctacgggccg  ctgcgctaca  gcgtcgccgc  gtcgccggc
1741  cgcatcgca  acttcattc  gcagcggca  gtaggcggca  gtgccggcc  gaacgatccg
1801  ctcgtgttcc  agtccgtaaa  cttcacgtg  gcgccattc  acggcttcac  gggacgcgcc
1861  gaatcggtga  tgccgaatgg  cttcacgtg  aagacgcga  acggttcac  gaaggcacg
1921  acgcaggaca  acggccggc  gagcgagccg  ctcgatccgc  tcaacccgtt  ctcgccgtg
1981  ttcggcgtgc  gctacggacc  gggcgagcc  cgtgtcgtcg  agggacct  gctgtggcag
2041  ggggcaagc  ggccgtcgt  cgtcctgcga  cgtgtcgtcg  agaaaaagac  ctgcttcacg
2101  cgccgtcgt  gcattcacaa  cctgttcgac  ggccgtacc  gcttcaacaa  gcacgtgagc
2161  gctacctcg  gcattcacaa  cctgttcgac  cgtcgcgac  gaactggtc  ggactgcgc
2221  ggcatccgcg  ccgattcgac  cgattcgac  gcatcaccg  cccggccg  cagcgtcgcg
2281  gtcagcatga  agtggattt  ctga 103    88

1    marrplraal  fgafglyaaa  araagpaseb  aaaappaaas  aasaastsqv  rhaaiaaark
 61   dapaldpitv  tatrtasaas  rtaasvvit  dsdleeqqad  nikdalryep  gvtvrrtayr
121   panaalgggr  dgdssinirg  legnrvlme  dgirlpsafs  fgpleagrgd  yadldtlari
181   eiilrgpasal  ygsdgltgav  nfitkdpsdl  lsihrkktyf  sfrpsydsvd  rsigatvtaa
241   ggndrvqaml  iasgrrghel  dthgddnsas  trrtranpqd  vyteslgkl  titptardti
301   klaaetvrrr  idtnvlsain  pptlgitan  drlernrfsi  dydirdaaar  gfqtahvqfy
361   yqestqddqa  fetrggrlqs  rsrsnhyser  algggsafaes  gfatgplahk  llyydgsid
421   rikslregtv  aspgesfpnk  afpdtdyslf  gafvqdqigf  gkllvtpgli  fdayrlspps
481   gdpliftgktv  sssdhelspr  vanlyeaspa  lipyaqyahg  frtptpdqvn  nsfsnpiyyy
541   tsignpnlkp  etsdtleagl  rgtlgtgyp  lrysvaafag  ryrnfisqrt  vggsgrpndp
601   lvfqyvnfan  arihgfegra  ewmpngftl  ktamaftkgt  tdngaasep  ldtvnpfsav
661   fgvryepser  wfaqadllwq  agkgrgrdvss  aacqktcft  ppssfvvdlr  ggyrfnkhvs
721   aylglhnlfd  rkywnwsdvr  giaadsnvld  aytapgrsva  vsmkvdf 606   124   124384342   YP_001028663

1   atgagccggg  cgcgtccggg  ccgtccgatg  cgtccgcgt  tcggccgcgt  gttcgcgggg
 61   cgctctcgg  cgcgtcacgg  ccgcgacgcg  cgtcgcaccg  cgcacgcgtg  cttcgccgcc
121   gcgtccggtc  gctcgccgc  cgcgacgggg  tgtccgccg  cgcgtcgcgt  ccgcgtccgg
181   gcgtccggcg  ccgagcccgc  cgaggcggaa  gggtgcacg  agcttcgaca  gtccgtccgg
241   gaactgccga  agctgcgcgt  gaagctccgc  gacgagcacg  cggttcgccg  gtccgaggtg
301   ctcgcgggg  gtctgccgct  gaagctgcgc  gatccgaca  tgtcgtcga  cgtcgaggtg
361   atcacctccg  cgcgatgacg  gcgcacgcg  gcaacggcg  tgtcgtcga  cagcgtcgcc
421   gcgacgggt  tcagcacggc  ccggcggcgt  cgtgtcgacg  ggcaacgcgc  cagcgtcgg
481   ggcttcgccg  gcaggaatc  gtgacgacg  ctgtcgacg  gcgtcgcct  ctacccgc
541   gcggcaccg  tcaacttccc  gtctcgacg  tggtcccg  agcgcatcga  ggtcgtcgcc
601   gggccgggt  cagcagctga  cggcgaaggt  cggcgcaatg  cgcgtcgacc  cgtcgtacc
661   cggccccgc  gccaggacg  ctcgcgaacg  ctcgcaggcg  cgcatccgc  gcaagcgaa
721   aagccgtgc  cgctcgataa  agggtgcacg  gccttccgtc  agccggcac  tcgttccat
781   ctgagccgc  agggccacg  gggtcgcgct  gaagctcgt  acgcgcacgt  gaggccgtc
841   gcggcccgg  tgaagctgca  tgctgattcg  tgtcgattca  tcacgctga  ttacgactac
901   ggcgcccgc  agcccgccga  ctattccgg  gtgcgcgac  cgaacggcgt  gctcgacgc
961   gcgctgccg  agccggccaa  caacctgcgg  gcgcaacctg  tcgcatacca  cgacacctgg
1021  acgcgcggtt  cgcgtccgg  ccggacctga  tcgccgggg  cggaactga  cgctcgatc  ccactctac
1081  tattccgga  tcgcggccgg  tgcgccgca  acggcgcaaa  atcttccatc  gcggcgcac  gttcgacc
1141  cgacccgtcg  cgcaccaacg  ctcgccgca  gttcgacg  cgcgaacacg  cgcctgatg  cgtgccgge
1201  cgcttcgagt  tcaaccacga  accgatcga  ctcgcggcg  gttcgacg  gcgcacgggg  cggcgaatcg
1261  acgcggtca  ccagccggct  caccgctgg  cgtcgacga  cgtcgcatc  ccggcacag  gagctgacc
1321  cgcttcgca  cgcacgcga  tcagccgcga  tcgcacccg  gcgctatcg  agaaccggct  cgagtccctg
1381  cccggctcg  ctgggtgag  ggggctgcgt  cgcaagacg  ttcggcaca  tgtcgttca  tcgcgacgat
1441  ctgatccggg  gcggccggg  gcgcgcggcg  cctcgcggg  gcgagactg  tggcgggg  cagcggctc
1501  ctctacgaga  tcgcaccagt  cctcgcgcgg  cctcgcccagt  tacgcccgge  gcggcgagt  tgcgcaggg
1561  gtcctcgaga                                                    acagacggt  tgcgcaggc
```

-continued

```
1621 gtggctcgc tgtcacgct gtcgggtcg cagggaact acaagctcgc gacgggcgt
1681 caatggaag cggcatcaa ccggcgagatc gacggcgctc gacggcgctc gagctcgcc
1741 gtctacgaca tcgccaagcg cgtcgtcgtc gctgaatcc gctgaatcc ggcgcgcgc
1801 cagcagatcg gcccccagtc cgtcgagcg gtcgagtcg cctgaatcg ggcgcgccg
1861 gggcgtgtga cgtcgacgg aaacggcg ttgctgcgcg gcgctacga cgttgcgac
1921 cagccgtcg gcgcacggt cgtgcagcg gccgcaacg gccgcacga catcgcgcag
1981 cagagccga acctgtgat tcgggcggc ttcgcgcgg gctgcgcgc gaacgggc
2041 ctgcgctacg tcgccccg ctacgggac gacgcgaac gcgtccggt gcctcttac
2101 acgtgttcg acgtcgct cgcgtgcgg gcgacgcgc agcgcgacct cgtgctctat
2161 gccgcaacc tcgccaacg cacgtacgg gcgtcgacgt tgaccgcgg cgcaatgg
2221 ctgctcgcgc cgtcgagctc gccgagctc gtcgagctc tgcgcttcta g
```

104

```
  1 msraphapsr rrafgrgfaa aaraahgapv ahgahacfaa asrataver cvtalacavt
 61 asgalaaeae padaargphr elptvrvtsd gvhaprlstp laagsrikla sldtpasvev
121 itsaqiaarg drtivdavtr atgfstaaap gnggtalsvr gfagqesvtt lvdgvrlypg
181 agtvtfpfst wsaerievlr gpasvlygeg aiggvanvvt rrprrerstt lqagigtge
241 krvaldttga lgarlsyrfh lsdertrgfv erqahvtav ggalkldvds rlsitldydy
301 grqkpatyfg vpatngvler alrernynvg datiayhdtw trlaatyrag ngvtldaqly
361 ylatrrhwrn aesyaldpaa rtvarsdyle ifhrerqfge rftaridsrv fgranrlvlg
421 aefnqiafdg annapyrges tvaaagfdpg afaspdtlp rfrrthqaa afienrlevl
481 prlawvsglr ydhlsfhrdd liaggafdkt fahtgwrsgl vyelapglaa yaqyttgagq
541 vgslvtlsas qanytlatgr qweagikhei dgaraywtla vydivkrglv svdpinpara
601 qqigrgssrg velaggvrlp ggvtvdanaa llrarydafd qrvgdtvvqr agnvphdiaq
661 qsanlwigwa fapgwranag lryvgprygd danrvpvpsy tvfdaslawr atradlvly
721 arnlanrtya astinggaqw llgpsrsael vatlrf
```

607 81 124383128 YP_001025604

125

```
  1 atgacatcca cattcctgcg tcacgcgcc gccggccacg aaggccacgg gcgccgcgg
 61 cagcgcgcga tcacgcttac cggccgcgg cgttccgcga cctcttca ctgacgtcgg
121 gccgcgcg agacgagcga cggccgtac ggccacacgg cgtccgagc gtccgggta
181 gcgagcccgc ccgagaccga cgccaatcgg gccaacagg acgccacga acgcccgac gatcgaatc
241 gcgagcccgca cgcaaccgg cgccgcccg cgccgggcg cgccgcgga cgtccgcga gcgcgccag
301 gtccgggcgc cgaatcgac cgaagctgac ggcgtcgtc gacgacgga atccgaagac gccgccac
361 ccgccgggcg atcggcgacg ccggcgattat ctgaagacga ttcccgcgct tcgcgcgcg cccgcgatc
421 cgcaagcggc gacgaacgg gaccggtgg ctggccggga tgttccggtc gcgcgtgaac
481 atttccgcga acggcatgcc gacgcgtgt gcgtgcccg gccacgtgga ccgcgccgacg
541 tcgtacatcg cgcccgagag ctacgacaag gtggaccccg gtgcctcg agccgccgtg gcaaccgtg
601 ctgtacgggc cgacgcatc ggccgggacg gcgccacg agccgctttc gccgcgcttc
661 aagagcccgg gcatgcgctt acgtcgagct cggcccgggcg gtccgttcgg gcgcacgat
721 cagaacgtcg acgtactac gactctacg ggccgtgag tgccgtcgca atggacaag
781 gcgcactcgc aggactacga ggccgcaac cggccgcaac ttcccgcgct cgcgcgccag
841 tggaacggga atcgggcgt cgaccggac gcccgcacg acacgccgg cgactcgacg
901 gcaggccacg gcgacgcta cggccgggcg cggccgcggg gatgacacg gcgcatttc
961 cggccgggaga cgttcgagcg gaagtctgcgt aagagccaca cagtgacgct gtccgatgc
1021 atccggggcgc aggtcttcta caacgaagcc tggacaacta cagttgcgg
1081 atgccgatg atgccgcatg catgccgcgc cgccgcgac tcggccacg cgccgcacg
1141 ctcgccgcgc gctcgaaccg ctcgactcg cgccgggcga ttgaccaccg cgtacgggc
1201 gtcgatgcgc acgtcgaacg gcgaaccatg tggaacggg gggatgcca gaactacggc
1261 gacaagcgt ggaatcgca gcgccgacgg gcgacccgg ggatcgctc cggctgacc
1321 tggtatgcga gcgacgtc gcgacgacgt ggccgggcg ggccgacg ggatcgaca tgcggcgac
1381 cgcgacagc cggcaacgg gcgcgcgg gggcggcat aagatgagca aagatgagca gacgctcgaa
1441 gatctccgt cgcgcgcct cgttcgcagc gcccgagggc ttcgcgcct acgagcgtca tctcgcgtcg
1501 ctgcccgtca cgggtacgg gggcatcgc catgccgagc cgtccctga ttactgggag
1561 ctgttctccg ccaagcggg cccgaaccgg tcgatcaacg cgttcaaacg cgttcccgc gatcaagccc
```

-continued

```
1621 gagaagacga cgcagctcga catcgcgcg cagtacaaga gcgcaaagct cgacgcctgg
1681 gtgtccgcct atgcgggta ctgcaggag tccatcctgt tgactatgc gacgggccg
1741 atggacagag tcacgcggc gacgaaccg lrgmcgcaga aacgcggaa tcatgggcg tgaggtgggc
1801 gcgtcgtgc gtccgctcgc gcgctggc ttcgaaggt cgctcgtga tgcgtggggg
1861 cgcaacgtgc aaagcggtgc gccgctgcgc cagatgcgc ggggtcgt acgcttcgc
1921 gtccagtaca ctcgcgggcc ggcacagtc gtcggtcgt gcgggtcgt tgccgcgag
1981 catcgctacg cgctgaacga cgtcagtac aactgagca acttcggtcc gacgccggt
2041 ttcgcgcgtc tgtcctgcga ccgcagtgac cgcgcagtgc agacgcggt gatccggtc
2101 gggtcgaca agtgctcga caagattat gcggagcacc tgaacctcgc gggcaacgcc
2161 ggtttcggct atccggcgaa tctgcctgtc accgaaccg gccaaccgg gtggttcgt
2221 ttgagcacca agctctga

105

1 mtstflrhap aareghrrr rraitltvpa laagafhlap avaqtseavh ghgtlgasgv
  61 asraetdaas akedgavrea asrtatgaap dattiptiei vaapestplv vvtdpktprq
 121 plpasdgady lktipgfasi rsggtngdpv lrgmfgsrln ilangmptlg acprmdapt
 181 syiasesydk vtlvkgpqtv lygpsasagt viferrvtprf ktpgmrfdgs vvggsfgrnd
 241 qnvdvtagtp dfygrvsanh ahsqdyeqn grtvpsqwdk wnadaalgwt pddntrlelt
 301 agtgdgyary agrgmdqahf rretfglkfd kkhigdvldr ieaqvfynea dhvmdnytlr
 361 mpdptssmpm rmasevrrrt lgarvaatlr ltdaaflvtg vdaqsnrlds rsamgmqnyg
 421 dkpwnpqanm wnagafgelt wyasdasrvi ggaridyaaa rdkrattggm kmsmrnptfd
 481 dlrsrvlpsg fvryerdllas lpvtwyagig haqrfpdywe filfdyatgp lfsakrgpng sinafsailkp
 541 ektqldiga qyksdkldaw vsayagyvqd rnvqsgaplp qmpplearfg mggitratnv naqimggevg
 601 aswrplapwr fegslayawg gvkdfgpsag fgvlslhaqy nvsktvqisv gvdnvldkty gglwrvvapq aehlnlagna
 661 hryalnegnv vgkdfgpsag fgvlslhaqy nvsktvqisv gvdnvldkty aehlnlagna
 721 gfgypanlpv teprrtawvr lstkl
```

126

```
   1 tcagaactgc agcgtcgtca ctgcgcgcg tcgcccaccg acacgaagaa
  61 ccggtcaaca atacgggt aatacgcg gttgaacaga ttcttcacgt tgagctggaa
 121 ctgcgcttc tgctgccga gccggtgtc gtaggtcgg acgcttcgg cggtcgta
 181 cgcggccagc gtgaagtgt tggccaatc gcccgggcgc gtccgacgt agccgcccgc
 241 cggcccgatc gcaggtcgt cgccggccc gccgtgtcc acgtcgtaga ccccgcgag
 301 cggagccgtg tgccgcgga cgttccacag ccggtgtcc acccagcgc gatcttcgt
 361 cgcttccgcg agatgatgc tgtcctgaa gaacagcgc caaccgcgc cgatccgcc
 421 cgacagtcg agctcgatcc tcgtcgtacg cgcgaagcg gactgcgcc acgcggtctg
 481 gtccgtcgcg tcgtcgtatt gcgagacgag cacgcttcg ttgtcgatgt cgaagaacgc
 541 gagcgtaccg ggaggccgc acgtgcagg agctcgcgg gtcgcccgcc acgacgcc
 601 ttcccggcgg gcggtccga cgtcgatcac gctcgatgac gccatcggcg cgatcttcga
 661 ggtcggcttc agcgactgt tgtagctgcg gccaactcgt agccggacgt agccggtcgt tccacttgta
 721 gacatgccc gcgcgggca cggccaagt ggctagtcg gccagcagcg gacccgag cctgaaccg
 781 ccggctccgc tgcctcgga ggccaagt tgtcctgaa gaaccagcgc gaacagcgc gatcttcgt
 841 cgcctcgcg agatgatgc cgcatcacg tgtcctgaa gaaccagcgc caaccgcgc cgatccgcc
 901 ctgtcgctg tcgaggcgg ataccgtcg cgaacagtt acgaccgcg agtgcggtt
 961 cagatagctg aacgcgctct tgatcgctg gcgcagcatg gtgcgcatc cggcgagcg agactgctg
1021 gtattcgccg tcgacgccga actgcactgc actgtcgat gtgccgatcc cggcggaggcg tcaccgacc
1081 gtccgcgtac gtcgatgccgt agctgcgtgaa gctgcggaa cgttcacgg cgtcgtgct gtcgttgct
1141 gcgcggtgagc gtgcctgga gcggatcgac gcggatcgac cgaaatcgt cgacatcgta
1201 ggtctccggg ttgtaggtgt agcgagactg cacttccag gtcgcgcga gctgatgc
1261 gatcggagc tgccggagat gcgattcgcg cgatgttcg gcgatgcgt ttgaacggct cgtcgagccg
1321 gcggcagcc ggatccgga gcggtacgcg cgcgggcgga cgtgcggaa tcgacgcga tgccgtgta
1381 gaacggcatc aggagcgcg ggactcgta cgacagcgca acctcgtat cgcgcccgta
1441 ccacgcgagc gaagccgga cgagcgtctc ggcggtctcg agactgctg gccaatactg
1501 ttcgttcgtc tgatcgacga tcagccggta tgcaacgcg gactccgca tcgcccgt
1561 cgagtcgaac gtgagctcgc cgcgttcct gcccgccgc gactccgagc tacgcgcga
```

608    81    124381644    YP_001024240

```
1621 gatcgcgtg cggcgccga gctgcggtg cttcgtgacg acgtgatca cgccgccgg
1681 gtccatgatt cctacagca gcgaggccgg gccttcagc acttcgacg tgtccgtgt
1741 cgcgttcagc gagcgatcg cattcggtg cgcatcaccg agccgtcgc
1801 gttgtcgccg aagccgcgt tcatcaccgt gtcctggtg ctgccgagcg tgtgccctg
1861 cgtgatgccg ctcaagttcg caagccgttc gtcgagattg cgcggcgct ggtcgcgag
1921 cacctgctgc gcacgatgg gctgccaccg cggcacctcg cgcgagcggc cgtcgctgcg
1981 cagcccggcc gcctcaagtg ggcgccggta gctgtccggc gcggcccgc tcggcgcac
2041 ggcgacggtg gcgcggcgg tgcggcgca tcggcgcga cggagccgg cggagccac
2101 cccggcagc ctggcgagcg gctagccgcc gctcggctgc cggagccgca gccgcccgt
2161 gcccgtcagc agccggtcga cgccgccggc cggatccgcg gccgcgtgca gccggggct
2221 tcgcaggccc gtgtcagct cgccgggaa ccaacagcag atgccggctt cgcggccgaa
2281 cgggtcagc gccgcggag cggaatcgc tacccgccg cgggcgggc
2341 cggtccggcc gcgcccgata cgcccggcgc ggcgcacgc gagaacagcg cggcgggcgg
2401 cacgcgccg acgacgcggc cgggcgcaa ttgccgcgt cacgccgcgt gcaacgtgtg
2461 cgagccgcgt gatgtgtgcg atgtggcttg cgccgcat cgccgggcg ccggtcgcg
2521 cggcgagcct cggcgagccc cgcgagcgc ctgagcaaac cggccggcgc cggcggcgcg
2581 gtgcggccgta tccgcgcaca cgccggcgtg cgcggccgg gggcggcggc tgcagattga
2641 atccatgatc gatgactcgt tgacgatggg tgaatgcag ccttcattc ccatgtcacg
2701 cgagcatcga aaacagctca ggcccggcga aaaatttcg atgaggcatg cggcgcgt
2761 gcgcaa 1 mrtraaclie ifspglscfr csrdmqnegc ippivnessi mdsicnrrpr rahagvcadt
 61 ahapaglpea aqpaarlgag aqpdaaaprc arqatshtsh ashtlhapcm pqfaprvva
121 rvaaaalfsa caapgvsgaa epaaatrgyd ipagpldaal trfgreagil lsfpgeltg
181 lrspqlhgra dpaaldril tgtglvalrq psggytlarl pgpaaagada aladttlpt
241 vavrasgpha dsvrppreaa glrsdaplae vpqavaivaq qvlrdqrprn lddalanvsg
301 itqgntlgst qdtvmkrgfg dnrdgsvmrn gmpivggrsl natdsvevl kgpasllygi
361 mdpggvinvv tkqpqlarrh aisalgstyg ggrnggeltf dstgaigesr vayrlivdqt
421 neqywrmyge hretlvapsl lsyeyrrflm pfdrgtaldp rthaplaipa
481 rrrldepfnd mrgesnlaql awygrdtqvv kvhvgysynr etydanqiri tavdplkgtl
541 trsndathgs rstdsygiay vdgrvtlagm rhdvqfgvdg eyrqvyradm lrqpiktpfs
601 ylnptyglvp pstsvsaads dqsdtlhtas lffqdsihls lygsytqslk wvryysqlagr
661 grpfqvntnl sgtkwlprag ivykwndals ivykwndals ptskiapmag gyvidgstap
721 eegaswelga kldmpgglag tlaffdidkk hvlvsqydda tnqtawrtsg rarsrgield
781 vsgrigarwn viasyayida kttedpiyad nrlwnvarht aslaavydvg tvlggddlri
841 gaagryvgar pgdsansftl payatadafa tydtrlgkqk lqfqlnvknl fmrtyypssv
901 nrffvsvgda rqvslltlq f
```

106   124385832   YP_001028928

```
  1 ttactgcgcc gcttgcgcg gatcctcgacg cggcaggta gcgcgcaggtag gccgcggcc
 61 ggcttccgtt gcgttgtcgg cgatcggttt cgacgagccc atgccttgcg cggacaggcg
121 gtccgaccgc gcgccgccgt gtcacgacg cgtccggtt cttgcgcgg gattttgga
181 cagccgttga ttgtgccgcg tcctggttca ccgtcggcg gctgtcggtg gttccgacga
241 gatctgcggg gactcggcg gaggcgttc gaccgagctg agcagccgg gctttgagcga
301 gcgcatcgcg tgtcggtgtg cgttcggtgg cctgcgtcg cgtgcgacg gccagctgtt
361 gcgcacgcct tgttcgtgga tgttcgtcg ctgcgtccc gccacggcac agcgcccgcc
421 cttgatcgct tgccagtgt tgccagtcgt aacccgcac gccagcgcga agcggccga cgcgcggcc
481 gatccgccgc cccttgccgc gcgcagcgaa cgcccgatg gccgcgcga gccgcgcca
541 cgtccgtc gcgacgccg tgttggtgcc cggggtt cgaaccccg cgcaaccg ccgcagggc
601 gccggagaga gcgaaaaacg acaagcgcgt cgcgatttg gtattcat
```

609   27   127

```
610   19   124383503  YP_001028612
               1 mntkiatrls vfalagalla gcatqggtnt avgttgaal gagigalagg gkqaaigagv
              61 galvggvtgy nwqaiknkla psaqqtgqv teqpqgslkl nvpssvtfat dqyaitpaft
             121 plindlattl nqnpqitasv vgytdstgsa ahnqtlsqnr agsvvnalaq rgvaanrlsa
             181 qgmgasnpia dnateagraq nrrvelyra pqaaq 611   24   124386037  YP_001028612
               1 ttactgttga tagacggagt ccgacggcg gttctgcgcc cacgacgctt cgtcgtggcc
              61 gagcgcaacc ggctttcct tgccgagact cacggcttcc atctgcgcat ccccgacggc
             121 gagcagcgac agccgcggc gcacgccgc cgacggcttc tggccgagcg cgaggttgta
             181 ctcgctcgtg ccgcgctcgt cggtgtgc ctgaatcagg cgtggcgt gcggatggct
             241 cttcaggtat tgccgtgtt gctgcagcag cgcctggtat tggcctgca ccgagtagct
             301 gtcgaaatcg aagtacacgc tgccggttct gagcgggctg ttcgatcgt tcagcggatc
             361 gacggtcacc tgccgagcc tgccgggatt tttcgggatt ccggtcggtg ctgaccggtt
             421 ccgtgctcg tgcagcttca cgccgactt cgccgactgc gcatcgccg agcgccga tcatcagcat
             481 ccgcaacgcc agacgaagtt tcttcgacat at 128  YP_001026945
               1 mmsikklrlaf amlmigalaa cksgvkldeh anqgdavstq pnpenvaqvt vdplndpnsp
              61 lakrsvyfdf dsyevqdqyq allqqhaqyl kshpqrihili qgntdergts eynlalgqkr
             121 aeavrralsl lgvrgdaqmea vslgkekpva lghdeaswaq nrradlvyqq 129
               1 atgaacggca cgaacgagct ctgctgcgc gatgcgttct ggacgccac cacgccaac
              61 gccaagtgcg atggcgcact ggtcgccag gcaccggcag taccaagccg cgacttcgac
             121 gctccggcca tcacgagcca ggcaagcgg aagcttgacg aactggccgc gaagttcgac
             181 aaggccgtcc tgaagtgacg gctcacttcg gccaagccg gatcgaact tgccgtccgt
             241 ggcatgaacc ggcatcgtcg cgaagagcgc cggcgtcagc aaccgtacg cggcaaccg
             301 tacaacgacc gtcgtcgt gaacaaggtc gctacaggaa ggcaagcag agtcgtacct cgtcagcaag
             361 ggtgtcccg cgaacaaggt ctacaacgaa cgcaaggcg ctcatcgcct gcctcgcacc ggtcacggc
             421 aacacctgca agcagagaa acacgaagag ccaacggaa ctacgccgct gcctcgcacc ggaccgcgc
             481 gtggaagtcg aagtggtcga aagtggtcga ggcagaga cacgcagga gtgcagtaa ggcgagtaa 109  YP_001024349
               1 mngtnelcwr dafwtpatan akcdgalvaq apapapvapv apaitsqkit yqadtlfdfd
              61 kavlkpagkq kldelaakiq gmnvevvvat gytdrigsdk yndrlslrra qavksylvsk
             121 gvpankvyte gkgkrnpvtg ntckqknrkq liaclapdrr vevevvgtqe vqkttvpaq 613   44   124383016  YP_001024349
               1 tcagaacttg tgacggatcg cgcggaactg cgcgccgacg ttccgccgac ccgaggggcc
              61 gtccgtaccg acgacgtagc gccatccgcg gatcgctgcc gtctgtgcg cccgaccct
             121 ctgtacgcg cctgacggt cagtgccgtt gcgcttcgac agttgtagt cggccatcag
             181 gccgaccgg tggacttcg gctcaacgcc gccggccgc gatcgaact tgccgtccgt
             241 gtacacgtac tgccgcgcga acctggtcag cggctcagc cggcccggc ggtcatcgc cgttgattc
             301 gaagttctga aacttcgtg cgctcaggcc gctcaggcg gaggccgag acgaaaccga cgcgccgg tcgagcgata
             361 gaccgtcgag accgggtttct tcacgtcggt cttgcgag acggtctag acgaaaccga ccgccgcgg
             421 gcccgaaacg tcagtccggc ccgcaagcgg cttcaggcc tgaacatccc cttgcagg tgaagttcgc
             481 gtcgtgtcg gcgatccgt gcgcagagcg cccgccgcgt cgcgcaggt ttgtcccgg gcaggtacg
             541 ggccgagt tgcaggcc tgcaggccgc ccagcgtgta agtgcaggc atgcagact ggggttgtt
             601 cgagaagcg tagtgaccc gtcgtgtgc cgagcgcagg cgtgtcagcg ttcgcagag ctgtcgttgt
             661 cggccgcg tacttcgtca gccagcggcc tgttgtcag ccgtggcg tgtgcaacg gcccatcgtc
             721 gaccgacctg tggaacggct tggagcagcg tgccggccca tggcgcttc gcggtcaacg gcggaggta
             781 gtccagagc gaatcgtac aacttctggc gcgcgaggc acgcagag tcggacaca cgggagtcgt
             841 gaccgcgag accgggtcct cacgtcggt gcgctcagg gcgtgtgtct gcccgcgg agcttctc
             901 gtccgaaacg tagtcgcgc tttccgcggc cttcgcggc cttcgcgg tgaacatccc ccaggaac
             961 gccgaggcc cagcggcctc cctgcacga aacccggga gtccggaa acgcgggcc gcgtcttgcc
            1021 gacgcgttg agttcacgt tgtccgtgta gttgaagcct gttgaagacg agctgtagt tcgtcgatca cggtcttggc
            1081 cgtgacgctg ctttggccga aaaccgcgga ggccgaaggc agcaatgccg agcatgcgg ctgccgtacg ctcgcgaaat
            1141 gacgtgcttt ttcat
```

-continued

```
614   39  124483230  YP_001024431

1  mkkhvisaaa llafaapvfa qssvtlygvi degfnytsnv nvnqvgksny qlasgfvggs
 61  rwglrgsedl ggglkaiftl engfdvnngr lgqggrmfgr qafvglshaq ygsltlgrqy
121  dslvdylapl tangnwggtl fshpfdndnt dnsfrvnntv kyaspdwngl qvgqtysfsn
181  atgfsnnrqy sigaaytigg lqlaaaylqa nnpgktagga iadndanfta drlrifgggv
241  nytfgpatvg fvytktdvkn pvstvylpta tfagiglsat kfqnfeingk yqltpalfig
301  aqyvytdgkf daaagsvrpk yhtvglmady nlskrtdvyl qgayqkvagd ktgtiadggy
361  vvgtdgpsas anqfavraai rhkf 615   55  124381981  YP_001025679

1  mnktlivaav aasfatvaha qssvtlygsnv dagitygsnv atpsgsgksl wsvgagvdqs
 61  rfglrgsedl ggglkaiftl esgfningpr fnnggmfnr qafvglssny gtvtlgrqyd
121  atqdylspls atgnwggtyf ahplmndrln tngdvavnnt vkftsanyag lqfggtysfs
181  nnsqfannra ysagasyqfq glkvgaaysq annagantg atdpltgfni ggtnaasigg
241  rsrvygagas yayqplqggl lwtqsrldnl angaptirad nyeanykynl tpalglgvay
301  tytytnakan gesthwnqvg vqadyvalskr tdvyaqavyq rssknanasi ynqdlstpfs
361  tsinqtaatv glrhrf
```

```
     1021 ctgccgtcg ttgccgtga cataagtgat cgactgtca atcacgcgt acagcgtgac
     1081 gctgctttga gctgagtg caccggtgc gcccagcagc gccagcagc gcgacgagag ggtagacag
     1141 agcgagtttc ttcat 617   55   124385469 YP_001028406

1 mkklalstls lallgaagaa qaqssvtlyg vidtsityvh gndgkannaw lmgsgnlqgs
       61 rwglkgtedl gaglkaifql engfnsndgt lgqgkrmfgr qafvglghdq ygtitlgrqy
      121 dplvdlvqpv tadnyfgslf atpgdvdhnd nslrvnntvk ytspvfagfq fealygfsgi
      181 agspgqqtw saaaayngp igvaagyfyt snpsptagsr stwsgssdai fdgainsgyt
      241 saksigiaqv aggyvfgpvt vglgysnaqy kpdgfsgfss tekyntgrgf vryqatpall
      301 lglgyaytka sgtdakyhq vsigadyals krtdvylaga yqhasgtqrv datttqtaqa
      361 sigygvngt kseqmvalgl rhkf 618   19   124381380 YP_001024890

1 atgaagcga acatgcttt gactgcactc gcagtcgcg gggctgcacg
       61 ctcgcgcgc gtctacgagcg tccggccgcg ccggtgtcgg cgcgacggc
      121 gtctatgccg ccagcccggg gctgccgcca gtcttcgtc gatcgaatcg ccaggcggcc
      181 gtcgatatcg gctggccgtg acaaccgcga cctgcctg tcggtgtca agtcgagatc
      241 ggctgaaga acaaccgcga cctgcctg gggcctctc ccgagctga gcgcacgg cacggcacg
      301 cagtcaga tcaacgcgcg cgccggccgg cgtgtcgatc accgggcagc gctccatctc gcgaacctac
      361 atccagcgca cgccggccgg tgttgagccc gacctttcg gccgcatgca gaccctgaag
      421 aactcggcg tctccgcgtc gtggagctgc gaccgtcg gcagcggca gcaacgccg ggactcg
      481 gaccaggcgc tctgcgaata cttccgcacc ccaagtgcgc acgctgt cgaagccga tctgcagtcg
      541 ctcgcgcga cacgccgga tcagtacctg gctggcgcg cctcctacg gcgtctacc atctgacga gctcagttc
      601 gtcacgcaga ccggctgaa acacgctgga gtcgacctg gtcgcccgc agacgctg cgagaccgc
      661 gacaacgcga ccggtcga gctgacctgg ggcgcgccc cgcgagacc cgctcaacgc agtcgtctg
      721 ctcgcgagc agcgctgcc cgagcgctcc cggctgcg tccgacctgc tcaacctgc gccgcacc tgcagccga
      781 ctgatcggcg acatccggc acatcccggc cgggctgcg acgccgaagc accatcccg gccgacatc
      841 ctgtccaccg agcgctgcgg cgggccgcg gcgcgcgcg acctggccgc tcgcccggg gcgctcggccg
      901 atgcaggcg agatctcgt acgcccggc caccgaccgg ttcgcacccg cagacgcgg gctgcgggc
      961 ttccccga cggcacggc gcgtggtcg ttcgccgga acatccggg gccgatctc
     1021 ctgttcaagg cgggcacggc agaacatcg gaacctcga ctcgcccgcag tgcgaagcg catcgagtcg
     1081 gagggcggc agaaggcgat ccagagcgcg tttcggcacg tgtcggacgg gctgccgg
     1141 gcgaactacg acgttcagca gatcgcggcg ctcgcaccg acgagcagg gcgagcggc
     1201 ccggatgcaga ctacgatgg gctgacctgt tcgccgggcg aacggtcg acagctatct gtcggtgctg
     1261 cgtacgatc tgtcggacct gggctcaagg acgcccagg cagcagttga tcacgcgcg gctgcgcgc
     1321 accggcaga cggacctgta ctcggcgca tccggcggcg gtgctcga gcgcggggc
     1381 tggacgaacc tctggacct gtatccgccgg gtatccgcg gtcggggcg gctgctcga gcgcgggc
     1441 gagacgcgga cccgccgga cccagcagca cgcgcccgc gattacgga aggcgcggc gccgcgggcg
     1501 gcgccgtgc cggccgtc cggccgcgcg gccagcgcg ccgacgcgg gctga 1 mkrhaltal avallaagct lapryerpaa laprveepaa alknnrdlrv svinveasra qyqitraglf
       61 vdigwreffv dpriqrllei dprigprlliei alknnrdlrv svinveasra qyqitraglf ptlsgtvgt
      121 iqrtpagvsi tgqplisrty nvgvsaswel dlfgrvqslk dqalaqyfat aqarkaaeis
      181 lvasvadqyl tlstddllq vqntlksar asydltklqf dngtgseldl lltdipaglp cqaqtvveta
      241 lasqaqara raqalnalvl ligepipdl padlpinaqn ffpkislstsa fgtastllgg sdlltrrpdi
      301 mqaeetlraa nanigaaraa anyekaiqsa taqtdiysaq frevsdqlaa lfkagtaaws fapnialpif
      361 eggqnianld lahvqkriel ngvdsylsvl aavpaasasa qqlisarlar rgtyqqiaa lernehaqqr
      421 rydlsdlryr dygkaapapa paag wtnlvdlyra lgggwlerag
      481 etrpadapv 618   19   124381380 YP_001024890

1 atgcaaggcg acaagaaagt catcgaatat cgaactgcg agtgaaaaa cgaactgacc
       61 gcgatcaatc aatatttcct gcatgcgcgg atgtacaaac actgggcct cgaaaaactc
      121 ggcaagcacg aatacgacga atcgacgcc ctgcgatcga acgggactg gctgatcgag
      181 ccgtgttca tgctcgacgg tgctcagacg ctgcgcaacg ctgcaagct gctcgtcggc
```

```
619    8.5                               241 gaggaaaccg aggaaatcct gaaatccgac ctgaagctcg aacaggtatc cctgaagaa
                                         301 tgcaaggaag ccatcgctta ccacgaatcg ttgcgaatcg gtgcctgatt acgtgtcgcg cgaaatcttc
                                         361 gagaaaatcc tcgacgattc cgaggacgac atcgactggc tcgagaacga aatcgacctg
                                         421 atcgcaagg tcgcattca gaactatcga cagtcgatga ggctctcgc ggaataa 114    124382608 YP_001024892       1 mqgdkkviey lnaqlknelt ainqyflhar mykhwglekl gkheydesig emkhadwlie
                                          61 rvfmldglpn lqdlhkllvg eeteeilkcd lkleqvsqat ckealayces vrdyvsrelf
                                         121 ekilddteeh idwletqidl igkvgiqnyq qsmmgrpe 135    124382074 YP_001024065       1 mqgdkkviey lnaqlknelt ainqyflhar mykhwglekl gkheydesig emkhadwlie
                                          61 ggcgtgaaca cgtcgaaga actccagttc gaacaggggg tcgccacctg ctgcgcaag
                                         121 tgccggggaa acgaccgcg gatcatggcg gaacaggcg tttgtcgag ccgtcggggt
                                         181 gccagcgcc ccgagcgct accggtcgcc gtcacgttct acgaacgcaa ggcggcctga 115                                  1 mivcvcksvs drkiraslae gvntfeelqf elgvatccgk ceetvreima eqgvcasrcg
                                          61 aerpaavpva vtfyerkaa 620    36     124382074 YP_001024065       1 atgtgaatt ttctggtcaa acgactgtc gggctgtcgc cgacgctcgc gtcgtcgcg
                                          61 gtgctggtgt tctgttcgt ccaacctgt cgtcgcgat ccggcgcc cgacaagccg
                                         121 cccggaccg acgacgcgac cgtcgccgct cgtcgctcgc atctccgcgg cgacaagccg
                                         181 ctgccggcgc agtcgcgag ctcttccgc agcgaccgag atccggcgag gctcatgcc gacgtcctcg
                                         241 acgccagca acggccgt tcagcatggc gcacatggcg tcttccgca agcgaccgag gttcatgcc gacggtacg
                                         301 ctgaccgtcg gacatggc gcaacgtc gcggagcgca gggcgagc ctggagagg gtcggcatcg
                                         361 gccgtgtgc gcaacccgg cgttccggc gcatcgtg ccggcctgc ggtcggtcg gaagctcggc
                                         421 tcgttccgg cgttccggc cgtcgccgg tgcatcgtg ccggcctgc ggtcggtcg gtgacgtcc
                                         481 tggctgcccg tgccgccgga tgccgccgcc gatgctgtg aagactacg tgcttcgtg gtgactcgcc
                                         541 ggccggccg tgccccgct tgccgccgg tcgccgccg tccacgcgcc cggtttcgt cgggtgtctg
                                         601 aacaaggatt tcgtcgccgc acagcgccgcc gatgattccg gtcgtcacga gcgagccgatc gctcggtcg
                                         661 aagcactgc tgcaacccgc tgccaacctg tgtcgccgag gcgcggttca actgccggg gtcagtcggc
                                         721 ttcctgctcg gggctccgat cgtcgtcgag gatgatgccga tacccggtga tccggtcggg tcgttgtgcg
                                         781 ctgtcgctcg atgccgatgc cgcggaccgac gatgatgcga gcgccgtgac tccaggcgat cgtcgtctg
                                         841 ttctcgctgg agtcatcct gatcaacctg gatcacctg agcgctacgc tgctcatcaac
                                         901 ccgacgtcg gtttcaagtg a 116                                        1 mlnlflvkrl gliptlacva vlvflfvhll pgdpgrlaag peadadtval vradlgldkp
                                          61 lpaqfasffa riahgdfgvs trskrpvate igerfmptlt ltvvsmawat lfgmaigias
                                         121 avwnrwpdr ftrasfevl sfpafalgml lmevfsvklg kgvrepmvvl wlpvvrpdgsw ksyvlpsvtl
                                         181 gaavaavmar nkdfvrtara kgvrepmvvl ypviqaivll vvtmmglqfg
                                         241 fliggsivve avfnwpgigr llvdavtmrd ypviqaivll fslefilinl svdvlyavin
                                         301 ptirfk 622    56     124383712 YP_001026175       1 atgaaaacct tccgtgtc cgcttgccg accgcgcgtg ccgtcgcggt cgcgcgctc
                                          61 gcgctcgcgg gatgcggaa gaagcgcgg ctattccggc ctcaagaacg acaaggcgat cgtccccgg
                                         121 gcgcagtcg agtcgcgca gagccgcgg cgccagggcg gccaatggc gtcgctcgac
                                         181 tgggagcgca agttcgcga tccgcaatta cccgcaggcg atccgcaagg ctcgacggc catcgagac
                                         241 aatccgacga tcgcgcagc gcaggccgac gcagtcgag gcgagtcgac cgtcgcgta cgtcgagcgc
                                         301 tcgcgctcga cgctcttcc ggcccccga ggggcccgag gcggccgcgt ggtcgaaccg gaacaacgcg
                                         361 tcggcaacg cgtcgatctg aggaaaagc gtcgatcgc ggccgcaagt tgggcaaga cctgaatgcg
                                         421 ctccgcgag aggaaaagc cgccgcgta gcccgccgg gctcgactct gacacctgg gactcgcgcg
                                         481 gccgtcgcg cgcccacgtc gcccgcgtag gctcgactct gacagaatca gctcgcgcc
                                         541 acgtcggtcg tctcgaaccg gcagcagtc caagccgtc gacaagatca ccgcgcgcg
                                         601 gggccgcgga cgaccgacaa gcgccacacga gcgccgccgg gctcgactct cgaatcgcgac acatcgcgac cgtcgtcg
                                         661 ggcctcgaca cgaaccgca cgaccccgcc gccgcggga aactgccgca gagccagtcg
```

-continued

```
 721 acgtgtccg atttcgacgg ccagatcacg aacgtccgct atcagctcgc cggctgtc
 781 ggcaaggtc cggaccgcgg gtgcagatc gcccgagccg tgctgagcgc gggggcgcg
 841 gtccgcctgc cggagaacct gcccgccgat ctcgtgtcg gccgcccgga tctcgtcgcc
 901 gcgcctgc aggtcgaagc gggcgatgac gacgtgaagg gccgaaagc cgagttcttg
 961 ccgacatca acctcgggc gggcttcggc ttcgacgcgt cccgcgatcc tccgacggc
1021 aacttcgcga gcgccaggc gcgccaatt gaaggccgc tacgcggact cgatctgtc ggtcgcgaac
1081 ggcgcgctgc cgtcgcaga cgctcatcaa cgcgccgaac gacgtcgca cgcaagccgc gtcgattcgc
1141 tacaaccaga cgctcatcaa cgcgccgaac gacgtcgca cgcaagccgc gtcgattcgc
1201 tcggtcgaca cgcaaatgg cgacgcgcag cgcggctcg atgcgtcgag gcgcgctac
1261 gagtcgcgg tgatccgcta caaggcgggc ctgtccgcgc agtttcaggt gctcaacg
1321 gacacgcaaacc ggtcgcgc cagcagacg gtgaagaacc tgaagatgcg ccgccgcgcg
1381 ctgcgatcg gcctcgtgaa ggcgcagcg ggcgccgtcg acgcggccg caccgcgtc
1441 gccgccccg ccccgcctc ggcgccggcc gcgccccgc agcacgcatc gaactga 117   1 mktfplsacr tavavaaal alagcanyfg lkndkaiapa aqfesarslp agggqwpsld
     61 wanqfqdpql pkildealeq nptiaqaqar iakassyies srstlpkad akywtrely
    121 sgnalfpppy ggqwysenna lasasweldl wgknrarlna aysqekaaea dlqqarvtla
    181 tsvartynql aqlyalrdia greisnrqtv dkitdgrvga gldtnverqt argniatesqs
    241 tlsdldgqit nvryqlaall gkgpdrglqi aapvlsagga valpenlpad lvsrrpdlva
    301 arwqveaamh dvkeakaeff pdinlaaqfg fdafqwgrfi nfasrqafg paihlpifdq
    361 galraqlkgr yadfdlsvan ynqtlinaln dvatqvasir svdtqmqdaq raldastray
    421 elavirykag lspqlqvlna dsnrlaaeqt vtnlkmrrrd lqiqlvkalq qqfdaaqtrl
    481 aapasapa apaqhasn 138   1 tcacagcgac cattcaact ctccataaaa agtgcggccc ggataaggat ggaacacgta
     61 gtagcgggcga tcgtcacgt tcgtgatgcc tgtgcatgcc gaactgcgc gatccgaacc
    121 atacgcgcc tcaggtcga cgaccatgaa cgagctgttg cgccggata cgcccggatt
    181 cacgctcgcc ttgtcgaagc cgtgccctga cgtgaacgac gagaacgac aacccaggc gcacgcgct
    241 catccaatgc tcgtcgagc ggtcagagc ggcaggttc gccagcatcc gcggaatccg
    301 cgccagcgc cgccgagt agtccgatt ggccgagcc gcaagcgtct gcgagttcgt
    361 cggacacg ttcgcgtcga cgcaccccc gcaccggtc cttggcgcg acgttcgtgt ccgagaacgc
    421 gagtcgacg cgttcgtcga tgtagatcga attgcgcaga tcgcctgga acacgctcgc
    481 gccagcgga gtgcctcgc cgcgaccga tccagtcga cccgctctcg tgccttttc
    541 gccacgacg cgaagccga cgtccgacact tgtgtgcact cgccgagatt gagatcgtga cctgaacag
    601 cggctcgga gtccgggtgt gtcgacgat cgcgcgagatc gacccgccgt agcggatcct gcagccgct
    661 ctgcgaacg gtcggaagc gcgaacgct ccgaacgac gtccgcagge gccacgcc
    721 cggcgacg cattcgaggc cagagcttcg cgagcaggca gtccgtcga gtccgcgta
    781 gccagcgtc cggtgagc gtcgagcgt gcaggcattc ccaagctc gcgaatccg
    841 caggccgagc gtcgcgtcga agccgggc gccggagcgcc gcccgagac cgcgaacgc
    901 ctcgtcgcgc cgttcaggtc cgtagcgcg gtcgagcgt caccgagggt ccgagaacg
    961 gtccgcgtgt ttgtggtgc cgtacgtga attgcgcag gaaatacgta tcgaagtgtgt agccgaacga
1021 gaaacggtgc cgagcgacct ccgggacact cgggcggca cggcggaag tccgaggtgtc gccagcccgg
1081 gccgtcgca ggtcgacga tgtgtgacga cgggacgcca ccggttgttc gagatcgtgc cctggaacag
1141 cgccagcgc agcagcagcg cgagccgcag cgccagccgct gtaggcggac ccgagacact gtaggccgcg gcgacccca
1201 gcgcgaacg agccggcgc gtccgccccc cgccagcagg gccacccgt cagttcttcc gtccccagt
1261 ctgccgcg aacgcggcgt gtagtcgc gccgcgcgt gtagtccgt cagatgcgc acacgtgcc
1321 gcgtacacc ggtgcccgg tggtgccgg tgaccgccgg caggaacgtg tccgcgtgtc gccgaggttc
1381 atcttcccag tgccgggagcg tgaccgcg gtcgagcgcg gcgtcgcgcg tcgatcgtc tgtgaagacc cgtaccccgg
1441 cgcaactcg tcgtgagcg ttcgcgagcg gtctcgattcg tcgatccga tcgatcgcc cgatttgcca
1501 cgccggcgc aacgccgt tcgggcccca tgtagttgcg ggccccgtc accgacacg gtgtcggagg
1561 cctcgatcg ggcttgcgc cgggttgccgt gtattgcatc ggctcgctgt gccgttttgt gcacgttgcc
1621 cctgcgcag cgcaagccg gacagcgcat tccggaacg tcgacgcga ggtcgatgc gccgcttcg
1681 gtgatgcg cggaagctgt ccgaagccg cgcaagcc cggcagtcg gtgtacgtcg cgaacaacga
```

623  85  124383487  YP_001026988

```
1741 ctgcgtcgac accgacgcct cgagccgctg cggcttgtgc gtgtgatct gcacggtgga
1801 gcgatccgcg ttgcccgggt agagccgcgga aaacgggccg tacagcacgt cccgcgtgc
1861 gatgtccgcg ggctggatca cggcggatac cggctccgcg gaatagctgg aacgagcag
1921 attgacagcg aggatgcctg ccgcatagac gagtcccgc gcgcctcgca gctcattgaa
1981 gtctcggccg gcgaacactg aattgggtc cttcggcgt gccgatgacg cgccggcgca ccatcagtt
2041 cggccgtac tgagcgcgt tcgacgcgc cggcgtgtc cacgtgacg tgcgaatcga tctgctcgcg
2101 cgtgagcgcg tcgacgacg tccggatgc gggccgaaac cgggcgcgct gcggcgtgac
2161 cttgacggta tccaaggtt tccatctcc ggtcatctcc cggcggccg cggcgtga
2221 atccggaggc acggcgggg ccgtcgaagc ccgtgggcg ggccgcag cgagccgc
2281 ggccggccg gcccggagc gctcgcgc gccgggcg gcaagttgat ggaacat 118                                                                         1 mfhqlaapga rrrlaaacaa alawpaahaa staaavpads tpaaaaemta sgktldtvkv
                61 taqraafapd tpgvvealtr eqidshvnvt tedalkyapn lmvrryigd rnsvfagrdf
               121 nelqsarglv yadqilisnl lgssysyppr wsliqpddia rvdvlygpfs alypgnaigs
               181 tvqitthkpq rleasystqf ftqryrdgyg fadsfgsnhq sariadrvgr fwyalsldrl
               241 endsqpmqya spngafdprl gapvpvtgav sdigpngprr tivgaqtier teqinetlrf
               301 gyaftdhvda tvtlghwenh yrqhgdtflr daagmpyyg nvsfggrnyt vspgafapqt
               361 gdqenwlygl gldarlasgw klsaiasaye vsrdvlrsas gappgawdgg pgtvfhgdgt
               421 gwrtvdlrae spdvrghrfs fgyhfdtyfl rnatyntadw qnavpttlvn ryrgntrtqa
               481 lyaqdawrva pdwlatlglr yerwdaygge lggatatlgy aergatafsp klslewpas
               541 awrlrlsfat gtrfptvael fgqtisnnai vnnnpnlqpe rvrvgvela kaidwdftae rdvgfgvvra
               601 svfqsdlrns iysqttlaga stytnvsnvd rvrvrgvela fsgdvalkg ldvdanvsat
               661 naqtladaan pnyvgatwpr iprmranlla syrfdehwmt svgvrysgrq ynaldnsdvn
               721 pgvyggtssf mvvdlkaryr fdrhwlasfg idnvtdrryy vfhpygrtf ygelkws1

624    78  124382059   YP_001025431   139

1    atggcgccccg cggctgcgcc tgataatgat ggcgcgagc cgtcgtatcg atggcgtgct tcacgggcct
61   tcctgtcgc acccgcgcga gttcctgtt catgcgcga ttcggccgt
121  gattccgtc ggtccgcag cccaccacca attaccgcaa tggatgacca ccgacgtatc
181  gcgcgcctt tcgctcgcag gtgcatccc ggcggcaacg cgtcgtcaac
241  catggcgaga cgggcgcgc ccgccgaga tgcgtgtgc acgcgccgc cgcgacgcg
301  ctcgccgcga tcttcgtgac ctcgtgcagc cggcggcgt ctcgccgag ctcgcccacc
361  ggtcgtcgt cggcgcagc gcgccagcg gcgcgcacg attcgtcgg cgacgcctg
421  aaccgccgc cggcgcgtc cacgacgcgc atggcgcag tcgccgccag gcgtacgcg
481  cgggatgg acggcatcg catcccgctc cgcgtgccg ctgcgaaacg cgtcgcccg gtacgacgcg
541  tcgtcgtgt cctacgatca cgcggcgcgc tggtgcgcg ggcggcaacg cggtcggcg cgtcgtcaac
601  atcgtcgcg aggacgcggc ccgcgaagcg atcacgcgcc tcgggcgc gtcgacgcg
661  acgatcgaca accgagatcc ggccgaagca cgcgccgcgc cgcgtacgg cgtcggcag
721  agctacgcg gcgcgaacaa ccgcgtcgc ccggcgcgc cgcgtcggc tcgtcgaagg cgaactacg ctccgcgcc
781  cgttccgcgt ttcatccga cggcgcgca cctcgtgac cctcgacgt ccgagaccg gattccggc
841  catgcgcatt cggccgcca cggcgcagc tatggcggg cgcgcacc agccaggca gcgctacgg
901  aggccgccga acaacgacg ccgccgtac gccgcgacg acgcgacg agcgcgacg gtaacgttga
961  gcgcacgct acgtcggcc atcgcagcag gcctacgaat cgacaacgg ctccgtgcc
1021 gaaccgacg ccccgcgctca gatcggcga gccgcgtcg gagcgcgtcg gggtgcgc
1081 aatttgcgcg gccgtttctc ccagctgaaa ttcgacttcg gctacacga ttaccagcat
1141 aaggaaatcg aggacgcg gacgccgtc acgtttcga atccagcgc cggagcgcg
1201 gtcgaggcgc ggcaccgca gctcggcccg ttcgaaggcg cgctcgaagg cacgccgga
1261 cagaacacgt tctccggct cggccgcgc cgagtgcga cgtaccacgg cacgacgagc
1321 gtcgcgtgt agcgcgcga agacgcga gtcgatccg agcgacacg cgtgaagct gtccggtcc
1381 gtcgcgcatc agcgcggcg gcaccgacg gctcgatcgg gcgacgaacaa gcgacacaa gtcgacttc
1441 gcgcctcgc gcgattcca tcgggcagc gtcgtcgcgg gcgacgcgg gcgctcgc ccagctccgcg
1501 ccgcgtggt cgctcgggg caacgtgcg tacacggcg gcgcgagg cttctacgag
```

```
1561  ctgtacgcga  acgcccgca   cggccgacg   ggacagtacc  tgatcggccg   gccgatcg
1621  cagaggaga   agccggtgc   gaccgactc   gcgccggct   atgcgagcg    tcgaaccgt
1681  ggcagcatcg  gcgtgttcta  cagccgcctg  cggaactgg   cgcagaata    cgaaccgga
1741  cgcccgtcg   acgacgacg   cgtgccgctg  ccccgggcg   ccgagcacgc   gctgccgag
1801  gcgtctatc   gggccgtgcg  ctcgagttc   tacggtcgat  agctcgaagg   cagtgggc
1861  gcgttcgaac  ggcgcggca   tcgcctgcga  ctcgacgtga  gcgccgacta   cacgcacgcg
1921  cgcaaccgg   acacgggcga  gctacggtga  gccgctcgcg  cggatcgcgc   gacgctcgc
1981  gccgattacg  gctccggcc   gtcccggag   cgccgcgagc  tcaccatgc    atggcgcag
2041  catccgtgc   ccagcacga   tctccgacc   gacggctaca  cgtcgctcgg   cgtcgtctc
2101  acctacaagt  tgccgtcgg   cgcacgaac   tggccgcct   atctgcgcgg   cgacaacctg
2161  acgaaccagg  acatccgcta  cgagctcg    gtggtcgca   acatcgcgc    gcaggcggg
2221  cgcagcgtga  gcagcgggat  gcacacgaca  tctga 1   mapaatraps   rridalphgp   scaliliryi   vscssrdsar   dsvhpdhttp   itamddhrri
 61   apffarrlhp   lslllaasla   hgetgappae   rrsdappata   lapifvtanp   lgasalsspt
121   aslsgdaltl   rrtdslgdti   nglpgvsttt   ygplvqrpii   rgmdgdriri   lqnvaayda
181   sslsydhavp   qdplsverie   ivrgpaally   ggnavggvvn   tidnripea   itgvsgalda
241   syggannara   gaalvegng   rfafhldafg   retdalripg   hahsarqral   dgedasepyg
301   rlpnsdgrry   ggaaggsytw   adgyvgasys   gyesnygsva   etdarlqmrq   ervalasevr
361   nlrgpfsqlk   fdfgytnyqh   keiedgvtgt   tfrnhgyear   vearhrklgp   fegalgvqvy
421   qntfsalgge   alapttrts   valfgleqwq   atdalklsag   ariehvrldp   sangdkfgf
481   arsrdfnags   vsagalyqla   pawslagnvs   yteraptfye   lyangphgat   gqyligrpda
541   qkekaystdl   alryasgpnr   gsigvfysrl   rnylaeydtg   rlvdddgvpv   apgadalre
601   avyrgvraef   ygvelegrwr   aferrghrvd   lelsadytha   rnadtgeplp   riaplratla
661   adyygpfga   raqlthawaq   hrvpehdlat   dgytslgvvl   tyklrvgatn   wlaylrgdnl
721   tnqdiryass   vvrniapqgg   rsysigmrtt   f
```

625  43  124383587  YP_001028404

```
  1   atgcgcgtcg   aacggttcc   ataccgctta   atcactgtcg   cgaccgctgc   cgttttcctg
 61   gccgtccagc   gaaaaaaga   cgcagcccgt   cccctcaaa   cgcccgaagt   cggcgcgtc
121   acctgcagc   cgcagtccag  gccagtcgcg  acggctgt    cgggccgtac   gagccgcttt
181   ctggtcgcgc  agtgccgcg   acggtcgac   acggcgcgt   tgcgcgcga   gtcacggaa
241   ggcgcgacg   tcaaggcgg   ccagcgcctg  tacaagatcg  atccggcacc   ctatatccgg
301   caattgaaca  gcgcagaaga  gcggccaaga  gacctcgtc   cgaacctgaa   gaccagaaac
361   cgctccgtcg  cgcctacaa   cggtgctgt   gtcgcgaaac  cgtcagcaa   gcagcagtac
421   gacgatgcgg  tgcgccggca  aggccaggg   cctcggcgat  tctcgccgat   caagggcccc
481   gtcgacatct  cgcagatcaa  cgcaggcga   acggatgcg   acgactcgg   cacgctgatg
541   gtccgcatcc  cgcaggtcc   gccgggcgcg  tacgcggcg   cagccaggc   cgacgctgat
601   tcgaccgtcc  agcagctcga  tcccgtctca  gtcgactcca  cgcagtcgag   cctcgacgg
661   ctgaagctgc  gcaggacat   ccaagacggg  cgtaccgg   ggaaggcc    gggccggcgc
721   aagttcacgc  tgattctga   ggactcga    gacctcccg   agccgagttc   gctcagttc
781   agcgatgtca  cggcagacca  acgacggg    tggtccgg   tcccgcgaac   cttccgacc
841   aagcagcgcg  tgctgctgc   gggcatgtcc  ggcatgcggc  gtgccgcgc   gacgtcaac
901   gagaacgcgt  tcctcgtcc   gcagcggcaa  gcagctc     tgtcaggtcc   tgtgtcacg
961   gcgatgatcg  cgggccgaca  actgggtgt   cgagagccgt  tcagggca    gatcgtgcag
1021  cagggccaga  aggtgcgcg   acgactgacc  cgcagggcg   gcgaccgct   gatcgtgcag
1081  ggcatcgaca  aggtgcgcg   ggcatgacc   ggcatgaccc  gtgaaggccg   cgaggctca   attccggcc
1141  gcggcgcca   ccgcgggcg   tgccggggct  tgccagggtc  gcggcgcg    ggccggccg
1201  gcagcgcgga  cccgcccgg   ccgtcgg     tgccgcccg   tcgagcctg   gagccgcaa
1261  taa
```

-continued

| ID | MW | Protein GI# | Protein Locus# | SEQ ID NO: |
|---|---|---|---|---|

120

```
  1 mrvervpyrl itvataavfl aacgkkesap ppqtpevgvv tvqpqpvpvv selpgrtsay
 61 lvaqvrarvd givlrrefte gsdvkaggrl ykidpapyia qlnsakatla kaqanlatqn
121 alvarykvlv aanayskqgy ddavaaggqa aadvgagkaa vetaginlgy tdvvspitgr
181 vgisqvtpga yvqasqatlm stvqqldpvy vdltqsldg  lklrqdiqsg riktegpgaa
241 kvtlilledgk pypergklqf sdvtvdqttg svtiraifpn kqrvllpgmf vrarieegvn
301 enaflvpqig vthdpkgqai amivdgkgkv eprvlvtggt qgqnwvvesg lqagdrvivq
361 gidkvrpgmt vkaaeaqlpa aagasgaap  aggspaqaaa asaaasgaap ssaaaassaq
```

BcAU1054-700

| ID | MW | Protein GI# | Protein Locus# | SEQ ID NO: |
|---|---|---|---|---|
| 701 | 81 | 107022717 | YP_621044 | 165 |

Sequence

```
   1 atgaaaaaag tggagcagaa gaagatggag tgggcaacag gcacgcgttt gcgagagatc
  61 gcagccgcgg cagccgctgg caagccgcgg gttccgtacg gcgggcagg  cgccgcagacg
 121 gcgcgccggc tgaaccgcgg ctggccgggc cgccagca   gtgccgcaaa cggcgcgacg
 181 gcgagacgt  cgaccaccgt cgaaccggc  gcaagcgca  acgctgccgg caacaccgcc
 241 tcgcaggtg  acggcacgt  cgggcacgt  cgggcagca  atcaaccgca  accgcggcc
 301 gacaccgcgc tcaacgagat cccgcagacg ctgcctcacg tcgcgggctt ctcgtcgtac
 361 atgaccggcg ccacgctcga ccgctccga  ctgtacgcg  gcttcatga  gaccgctac
 421 ggtcggaca  accgctgca  tgcaggtgc  gaacacgatc aaacctcga  gctgccgcga
 481 gtgaacgggc gcaggtgc   gatcaacgt  gctgccgcgg ccgacctgg  tgctgtacgg agaggggcgat
 541 atgatcgaca gcatcaacga tcatcgaca  cgcaccaca  ctcgacacg  gcgcaaagct
 601 ccgggcgca  tcatcgacgt  cgcgccgacta cgcgaccgcg  cagttcatga  tcgactcgg
 661 gaccggccag gccgcgaact acgtatgc   gccggtc   gtacgcgccg  cgtccacgct
 721 gaccggacg  gcagtatgc  gcaagtgcg  gcgcggtcgg ctcgacgct  ctgagcagct
 781 acgggcccga acaacgacca cgccggggcg gtccggcagg acggtcacgc cctccagcag
 841 gcgatcacgt cgctgaccgt ccgtgacgct gtgtgtcacg ctgtgaccgt actgggcga  catctcgctg
 901 aacttcctgc ccgccaagg  cgcaccgcaa acggccagat aacggccagat ggacgacgc
 961 atctacgaag gcgacggca  ctcaactac  taccgccga  acgcggttca  acatgcgat
1021 cagttcgagc gcaacctgac gcgaactgac gcgaccgcc  agtccgccc  acgcggttac
1081 ctgtcgctcg acacaccgtc gtggtcgcg  aacggttcg  acgcagcag  cacgaccgac
1141 gtgtcgcgct gggcccggcgt cccgggcgt  aactacacgc gttcgacat  cgacaaaac
1201 ctgaggggcg gctgcgacc  ggcgcgacgtg ctcgccggc  cagcaaccgc  tgtctgcgg  cttccagtcg
1261 aaccccagc  cgcgaaccga cagcgaagg  ctcgccgccg gcgcgcagcg gatccgcacc
1321 aaccgtgct  accagccgct cacgcagcg  cggtcacgc  gtgtcacgc  cgacgccgc  gagcggaac
1381 aacacgtaca acgcgatcaa cgacgatcaa cacggtccgg cggccgggtc  aacggcggat ggacgacgc
1441 cgctgaccgc gtcgacgtca cgtcgacgaa gccgcagtc  acatgcggat ggacgacgc
1501 gcgcacggca cgtcgacgaa gcgcaggca  gcgggtgtca  acgcggttca cggacccgag cggcctccg
1561 taccagggcg actacggt   gtcgctacg  gtcagctacg  gtcagtcgtt caatccgtg
1621 atcggcctga actcggtcgg cggcagtcgg ccgcagccga cgcgccgcaa gcagccgcaa gcaatcgaa
1681 gcgagaccc  gctgcagcg  gccgggcaaa aacctgatgc tgaacgcgga tatctaccag
1741 atcaaccaga ccaacctgct cacgctgct  cacgtgcg   ctgcgcggac aggaaccgac cggcacgaag
1801 tcgtgcaga  ccgggcaagt gcgctgcgc  gggatcgagc gtctatcagg cggcaaggtc
1861 acgcgaaacc tgctggtgat ctgctaccg  ctgccggca  aacattccga  cgtgcaggcc
1921 aacgacgtct cgctgcagca ctggccgcag ccgggcaag  aacctgatgc tgaacgcgga gatctccagg
1981 ctgtggaccg actgaaccctg cacgcaccggg ccgctgcccg gctgggcct gcgctccgga
2041 attcgctacc agagccggtg tgctatgcg  gccaaaact gcggcgtaact gcgtgaacgt
2101 acgtgttcg  acggggccca ttacacgcc  ttacacgcct gtgcaccgg  gatgcgtg
2161 acgcagtct  tcacccggt  gccgccgcc  ctacagctg  gttgcacgg  cgaacaaagt gtcatttc
2221 gggaccgacc gcaccgtgat gcaccgtgat ctcgccgctg cttacgcgg  cgaccgcacc ggtga
```

```
141
    1 mkkveqkkme watgtrlrai aaaasvafgt aaaghayaqt apavnagata sassaqtgat
   61 attttsaqng tlpaitvnaa sagdgtvglv akrstgtkt dtplneipqt invttaqqie
  121 mtgatdvnaa lryvpgfssy gsdnrsdwya alrgftptay vnglgvpnti nlaswrvdpy
  181 midsisvlrg ptsvlygad pgaildvhtk ladgervrea gvqignyark qfmidvgdkl
  241 dpdgkyayrf vgvardgnal tgpnndqrva lapsfrwrpd adtltlsat ylqdwgdiss
  301 nflpaqgtvl pmpngqinkd iyegdgnfny yrkkqwsvgy qfemltpaw tfrqntrimh
  361 lsldngsvfg ngfvegsttd vsrwagvfqm nysrfdidmn legrfatgpl qhtllgfqy
  421 nrqtatdsew laaapplniy npvyqpvtta vftpdatirt ntytintfg lyaqdqikwn
  481 rwtltlggre dwnmrmddr aagtstkadv taftgrvglt yqgdyglspy vsyatsfnpl
  541 igvnlvgggl pqptrgkqie agirwqppgk nlmlnaaiyq inqtnvltsa lpsqdptgtk
  601 svqtgevrsr gielsatgkv trnlsvlasy vyqdvknvqa ndvslnnwpv dippqrmas
  661 lwtdwtwtg plagfglgg iryqsasaga adnslvssv tlfdaglhyd vrnwrfavng
  721 tnlfnrhyis gcqsnnvcif gctdrtviata kynw
```

```
166
    1 atgaataact tgcacaacac gaacggcctg atgcgcttcg cgaaggtggc ggccgcgagc
   61 acctgcctcg cgacgctgct cgacgctgc ccgattacaa ccgatccgac cgctccggac
  121 gcggggcgc ccgccgcgtt caaggaagcg ccgacccctcg cgccgcgcga gcaggccggc
  181 acgtggaaga ccgccgagcc gccgaacatcg gcgaatggtg gccgaaccctcg gaaggtttc
  241 ggcgacccgg tgctcgattc gctccgagacg caggcgctcg gccgcaacca gaacctgaag
  301 gccgcgcagg cgccgcgtca gaagaacgag gtcgacgcgt ggtcgcgacg ctcgcaatgg
  361 ttcccgcagg cgccgctctg ttccgggccg acgcgcaggg ggctcgtcgt ggccgtcgag
  421 ttccagccgc aggcaccgg cccgaccaac gcgcgcgtc ggccgcaacg ggcacgcgtg
  481 tcgtacgacg gcgaagcctg gttccagctcg gttcaaggc cgacgtcgcg gccgccgac
  541 caggcgcaga gcgaaggtct gtcccgctcg cgttccaggc cgctgcg cgttccagg cgacctgcg
  601 cagaactact tcgaattgcg tcagctcgat cggaatccag acctgtaccg ccgcacggtc
  661 gagttgcgcg agcaggcgct gaagaacgaa caggccccgct tcaacgaagg cgacatcagc
  721 gagtcgacg tgtcgcgcgc gtccgagcag gtccgagacg ctggcgaccgg ggttgtcggc caaggcgcct
  781 ggcgattcg cgttcaagga acgcccgatc acgcccgag gtcgaccgag cgtcgaagat tccgcgggc
  841 ctgccgtccg cgctgctcga acgcccgccg acgcgcccg gtcgtgtcgg cggccgatcg cggccgatgcg
  901 gccgcgaacg ccggatccgg gtcgcgaag tcgcggtact tcccgaagct cgatatcacc
  961 gggtcgtcg ggtgatgaagc gtcgacgctc ggcaacctgt tcctgtggtc gagccgcacg
 1021 ttcctgctgg gccgcgttcg ggtcgcgctg ctgaccgtgc cgttccgagc cggcgggcgg
 1081 cgggtgctg gtgtgcagca gcgcgcgcg gcgcgcggcg agcaggtcgc gaactaccgg
 1141 cagcaggtgc tcgtcgcgtt cgcggaggtc gaggacaatc ttgctgatct gcgttgtc
 1201 gatgatcaga tccgcgcgca ggatgggcgc gtcaaccgt ctgacgtgtc gggacgttg
 1261 tcgccgcacgc aatatcagga agtgaggtc gcgtattccg acgtactcga cagtgaggcg
 1321 tcggtgttgc agtccgcagt gcaggcgaac cagttgacgg cagtggcagg ggtcgagacc
 1381 gtcaacctga tccgcggct ggcgcgcggg tggggaatg gcgcggccgc ggtgtcgacc
 1441 ggtgatgcgg cgtctgcaa ggctgcgta gctgcggt aa
```

```
142
    1 mnnlhntngl mrfakvaaas tllatllaac avgpdykrpd aaapaafkea ptlaaqeqag
   61 twktaepadg ehrgewwkvf gdpvldslet qalaanqnlk aaaarveear aatrsarsgw
  121 fpqvagfgp treglssasq fqpqgtqptn atlwraqgtv syeadlfgry grnveasrad
  181 qaqsealfrs vqlalqadva qnyfelrqld sdqqlyrrtv elreqalklv qrrinegdis
  241 eldvsrakne lasaqadavg varrraaseh alaillgkap adfafketpi vpvavkippg
  301 lpsallerrp dvsaaerama ananariglak sayfpkldit gsfgyeastl gnlflwsrt
  361 fllgpfagta ltlplfdggr raagvqqara qydeqvanyr qqvlvafrev ednladlrll
  421 ddqiraqdaa vnasrraatl srtqyqegev ayldvidser svlqsqlqan qltgaqavst
  481 vnliralggg wgnapaptav gdaasgkadv aar
```

-continued

| 703 | 84 | 107025915 | YP_623426 | 167 |

```
   1 tcagtagcgc ggttcagcg tgacgaacgc cgaacggccg ggccgatcg accatagtg
  61 cgccggatac gcctgatcga agtaggtcg gtgaacagg ttgttgacgt tcagtgcag
 121 gtccgagcttc ttgttgatcc cgtactcgc catcgcgtcg aagcccagt acgacggcac
 181 ggccggcagg ttccgggagt cgccgaatac ttccgacata ttccgacgac cgccggcgac
 241 cgtgaacttc ggcgtgacgt tgccgtgt cgtccgttg ccacatcgtc aggtcgtgt tcggcgtgtt
 301 cgggaagcgg tgccgtgcgg ccgccgaaca cctgccattg ctttccgttg tgcccagt ggtccttcat
 361 gtacgtgtag acgcgcttgt tgtcgatct tgtgaccat cgtgcattg tgtccgga ggccacgcg
 421 gagaccctgc acgcgcttgt gtgcgatct gaaacagcgc ggccgcagc tgttccggga gcgcacgcg
 481 tgccttggtc gtgtcgatct ggaacagcgc ggccgcagc gttttttcc ggcaaagct gatccgcgt
 541 gttccacttc gtgccgagct gcatgtcg cgatgtcgg tgactcgtt cgctccgct cgccagcat
 601 cgggccgacg gcctggaggct cggggtgag aggtccata atgtcgcgg atgcccgg tctccgcgg
 661 catgccgggc ggctgcata aggtcgcata gagcgtcg tcgcgtat agtcttgcc
 721 cttgaacacg agccggcct gccagttgaa gccagtgtcg tagatccg tcgcgcaa cgccgggcgt
 781 gcatctgcc ttggtatcg tgaagcgggt gctgaagccg gtcgaagccg tagatccgct tcgcgtgtt
 841 gacttgccag gccgtcgtga tctcgatcg tcctgcatcg gtcgaagccg gccatcgact tcgcggtt
 901 gcgcgcatgc tgcgcgtct tgtgccgcg gatgaagccg gcccatgccc cgttcgggtt cgtcgggtt
 961 cggcgaccac agctcgtcgc agttgtagcc cgacgcggg ccgaggcgg cgaggcatgc tctgcagat
1021 cgtgccctg tcggtcgcga ccgtgacga cctgtaacgg atccgcttg ccccattcgc gcacagctc
1081 gatacggtc gtgaagctgt gttgaacgg gctcagcgg gcccgtgcg aatccgcca acagtccgg
1141 cagttcgcg agcgtgtta tcgaagctgt tcgggcg ttgcgccg gtcgggcgg agaccttgcc
1201 gttccaccacg ttgccctgc ctcgcctgg tgtcgtcg ctgcgccag atgtagtcct gtcgcgatcc
1261 cgtagcgc gggtgtgc gcaccctga gttgcgtg atgcgcct cgatcttgat
1321 gctgctgatg tccgacggg tcttggaa agatccgcg gttgcgtcg atcagcgct agaagttgtg
1381 gctgatctg tgccccgat ctgcccgg gtgcgcat agatccgcg gcttgttccg agtgtgta
1441 gaagtacggg atgccgcct ccggcctgc gtccgctgc agtggtgt gcgacccc agctctgt
1501 cagcgcgtc tcgtgcgcga gccgcaacgg ggccgaacgc gatcgacgc gccgatcag ccccgaacgc
1561 gtgacggca tcgcacctg gcaactcgt agttgcgtt gcccggctc atcggttca ggcgaacgc
1621 gagcctcg gcgaaccgg tgcaactga gtcccggcgt gccgataag gctgcaag gtcgccgcc
1681 gaggccccg cgaactgta ctggggcgg ccgtgccgg aggtcgcgg gcctcgta tcagttgat
1741 gctgccgcg gccgcgcgc gcccgccgta ggccgcgtg caccgggcg gaaccgttc tgatcttgac
1801 gcgttcggta tgaagatct cgcccgcggt agcccggat cgccgcatgc tcgccgagcg cgtcgacgaa
1861 catgctgcc tgctgctgct cgcgagcgg ctgcgtctg tgcccgag cgccggagcg gttgcccgc
1921 ttcgggccgg ccgaactga tgcgggcag ggtgccgcga gctcgtca tcaggtgat
1981 gccgctctc tgatcagtt cctgcgcaat ctgcgggaat cacggcaag gattcggg tgtcgacag
2041 cggccggtg aatttcggg aagcgaaaaa gtcggcttg tagctgtct cggtcttgcc
2101 ctgatcctg atcggccga gtggccttc gtggccttgc ggccgcggcg ggcgcggcc gcgggtacc
2161 gtcggcgaac cgggggctcg cggagcgac cggcacaag gtggtgaact taccgagctt
2221 cagctcgtcc ggacggatt tcat
```

```
   1 mksrpdelkl gkfttlcsvl aaspafadgt ppaapasteg hlapieiqgk tehsykadfs
  61 asakftaplv dtpksvtvip qeliqssgaa tlteairtvp gitfgagegg npigdrpfir
 121 gydtggsmfv dgmrdtgatt reifnterve itkgsdayg grggaggsin litkaphlgt
 181 taaasaglgt dryrrftadg nwqfaehaaf rlnlmshnnd vagrdavmne rwgvapsiaf
 241 glgptrvta syhlqtddm pdggipyfyt tsnkpanvgt iypapvdrhn fyglidrdfr
 301 kttsdistik iehditpnlt vrnttrytes tqdyiwtqpd dsgqnvvngk vwrrnmnrns
 361 sinslanite lfgefrtgpf khsfttgiel srewgkrdsy tksiygfdti eitprwqvna
 421 nctslwspnp ndpwagsitr nndyahartt tksiygfdti eitprwqvna gvrvddystr
 481 ftdtkanggk tyrddtlfn wqaglvfkpa qngsiyasya tsstpagmml gegsetqslt
 541 pgrggvgpna dqlspeknrs ielgtkwnvl ndklsltaal fqidttnarv tlpnnqyanv
 601 snkrvgglel glaggitkqw qvfggytymk sqlrdngkda amgnrfpnt pkhsltmwsn
 661 ydvtpkftvg ggafymsevf gdpanlravp sywrfdamaq yrinkkldlq lnvnnlfnrt
 721 yfdqaypahy asiapgrsaf vtlnary
```

704 83 107027766 YP_625277 168

```
   1 tcagaaatcc actttcatgc tgacgcgac cgtgggccg ggcacgaat atgcgtcgag
  61 cacctgcgaa tcggccgca tgccgccac gtccgaccag ttccagtact tgcggtcgaa
 121 caggttgcga atgccgatcg cgtcgaact gtgcttgttc aagcgatagc cgccgccag
 181 gtcgacgacg aacagcgacg gcggcgtgaa gcacgcctg ttcgaacagt cggacttgtc
 241 gagctcctg tgcggtctcg taccgcacg cggcctgga cagcaggtcg gtcacgaca accagcgtc
 301 ggtcggctcg ggtcgcacg ccgagaacgg cttcgtgaaa ctccggtat gccatcgac tcttcagcgt
 361 gctcgccgg cggatcgtct ggtcgagcc gccttcgagg gccttcgacg ccggatcgc gggcgtcggc
 421 gatgccgtc ggcatcaccc attccgacga cggagcgtc acggagccgg ccgtgccgg cgagcgtcgt
 481 gaagttcacg tactggaaca cgaacggtgt agcggccggc gaagccggcc cgctgtagc gcacgacgcc
 541 acgcgagatg aagttccggt aggccggat gtcgccgctg gagcgcgg ggtcgctgg ggcacgccgg
 601 gtagccgttg atgccgatgc cgccgccttg gcttcgaac ggcttcgac gtgtcgctgg tttcggcgt
 661 caggttcgga ttgcggatcg acgtagtcca gtacacggt ttcgagaacg tccgtgttcac
 721 ctgtcggc gtcggcgcgc gaagccgtg cgctactgc cgtactcgt acgtaacgga tgaccgctgg
 781 agtgatttcg tagagcacgg cgacgccgg cgtttccggt cgacctcag ttgccgtcg tcgacacggc
 841 cttgccgtg aacagcggat tgatcgc tgatcgtcc gatctggtc gcacgaact cgaagccgag
 901 gcccggtcg acgagcagg gcccgtagcc ggcctgagc acgttcgt tgcacgacgc cgccgaacag
 961 cgtgagtcg gtgtcggga cgccttgt acgccttgtt cgggaacgg gtcgcgtcg cggaaccgt
1021 gcctcgcgc agttcgtca cgcgcacag gctcgcgtcg acgcgcccga acagcttgtg
1081 cgagcggg cgctcgaaa agccgcttc gcgaacgcg tagccgcca cgcgctga acgcgttc
1141 cttgtactg ttgcgcgcg aaccgcgaag cgccgcagg cacgcgcga cgcgctga acgcgtactg
1201 gtccctgttc gcgccctgt agtagaactg cacgcgcgg cacgcgcgc gtctgaacc agcggaacgc
1261 gtcgtcgga aagtcgtagt cgacgctgaa cattgatcgc gcgacagccg gcgtgctca cgcgcgtg
1321 gagcgcagc gtggcgcgg gcggaagcct tgatcgtgcc cgacgcacg cggtgtcgt cggacttgcc
1381 caccgtttcg ggcgtgaact tccgtcgtc tccgaataca cgtcctgggg attcgacgtc gtgccagcg tgccgccgga
1441 gagcagcgat tccgaatcga cgtcctgggg cgcctgggga gccgccgcgg cgtgccagcg tgatcatcc
1501 atgttgtcg cgcgcagcgt cgccctgt cgacctgtc ggcgaacgg tacgcgccgc tgatgctgc ggcggtcga
1561 ctgatgcga ttgcctgcg ggcgcgaacg agcgcggat ggcgcgcgc aggctgtgc acgtgatcga gcaggtcga
1621 gtcgtagctg ggcgcgaacg gtgatgaagt tcaccgcgt agatgtcga aggctgtgg tagatcgaca gcagtcggg
1681 cgggccctc gtgatgaagt tccttgatat gcaggatct cgatgcgtg agatcggcgt acagccga
1741 gcagcgcg tccttgatat gcgcagatgc cgatgcgcgt tgtgcgcgt agatccgcgt cgtgatcac
1801 cgccgcttcg gcccggccga acgagacga cgagacggat gtcgcagag gtcgatgctc cgggccgcc
1861 cagacgcga ttgcctcga gccgcggat gtgatgctc gttgatgctc gaatcgcgt cgggccgcc
1921 gcgagcgcg gcgcagccg gcgcagtacg gcgcgggat gtgatgctc agtcagccg ccgctcgta
1981 gccagcgcg tccttgatat gcgcagatgc cgatcgcgt tgtgcgcgt agatccgcgt cgtgatcac
2041 cgaacgac gcgcagacg gcgcgcgcg ggctcggcc gtgatggcg cggggcgac tgacggtgac
2101 gggatcgag agcgcgcct tgcgcccgct cgaggggcc ggatgacgcg gtcaggacgg cggaaggcgg
2161 ggggcgcct tgcgcgacg tgccgcgccg aatcgcgtg gccgacagc gccgacgcc gaaccgccc
2221 gaacagcgcg gcacagatcg gccgcgcgc gccgtatag cagcgctag caatgcac
```

```
   1 mhcytlarrp icaalfgafg lsaapahads spqgappsa vltaasarge aalldpvtvt
  61 atratasr taasysvitd edleeqatn ikdalryepg itvrrtayrp gsaalgggrd
 121 gdssinirgl egnrvlmed girlpnafsf gpleagrgdy adldtlkrie ilrgpasaly
 181 gsdgltgavn fitkdprdll siyhkpyyfs frpsydstdr sigatvsaag gndriqgmli
 241 adgrghevd trgdnnsast lrttsmpqv yseslgkklv ltpttrdtik ftaetvqrrv
 301 stdvlsaina patiglthd rlernrfsvd ydfrddafrw fqtahvqfyy qdakqddqyaf
 361 etrgrlpsrs rdnqykertf gaafaesgf stgplahkll ygvdgslsrv tnlrdgtvpg
 421 vgeafpnkaf pdtdytlfga fvqdqigygr llvtpglrfd tyrlsptend pltgkavst
 481 sanelsprva vlyeitpavi pyvqyahgfr aptpdqvnss fsmpvygyts ignpnlkpet
 541 sdtfeaglrg kagtgygvvr ysaaaftgry rnfisrttla gsgrpvdpfv fqyvnfadar
 601 ihglegraew vmpngitlkt amaftkgstq ndgaasqpln tvmpfsavfg vryepterwf
 661 vqtdllfgaa krdkdvdksd csnkacftpp ssfvvdlrgg yrfnkhvsat igirnlfdrk
 721 ywnwsdvrgi aadsqvlday sspgrtvavs mkvdf
```

```
705    81  107025731  YP_623242  169

-continued 1  atgcggtacg agtacggga acctgagaga tcgatgatgc aggcgcacg cgtcgcccgt
    61  ttcgggcgct ggcgtccgcc gctgtacctc ggcctgctga tcgccgcgca tccgccgcg
   121  gggttcgccg atcgccggcc gcggagcgca gtggaagtcc gcggagacc agcggccgcc
   181  gcgcagcctg ccggagcgcc cggagcgcg attgccgtga atgccgtcg cgtccgcgcg
   241  gacgatccgt ccgtggcgac ggtcgcaag cgagcagaca acctgtctc gattccgcag
   301  tcggtcagcg tgacgacgcg tcgacgctc cgagcagga tgctctcac gctcgacgag
   361  gtgatgcagc agtcgccggg gcttcaagt cgatccgtc gaattcacg gcgccggt cgtatcgcc
   421  ttcgcgcgcg gcgcgccgcg ggacacttcg gtgtacgaac gcgtcggtt cctgcgcggc
   481  gacatggcga gcgccgccgc ctcggccaat cccgccgcga ccgtcaacct cgtcgcgcaag
   541  gcgaacggc tgtgccacg ctcggcatgc accgccagtg tcggcagctg ggaccgctat
   601  cgcccgcaat accagttctc cggccagtcg aatgccgcg gcaccgtcg cagccggctc
   661  cgcggcgaag ccgacatcg cggccgctc ccacttcttc tacgaccacg cgaagcagga cacgcgttcg
   721  gtccgccgt acgaggatcg cgacgtgacg cgcgacaacgc tgctcacgtt cggccgcgag
   781  attacagcg tcaccgaaagt cgacatcggt gcccaacgc tccggcgtgc cgatggccg cgacggtcc
   841  taccagacca cgacatcggt gacttcctc gacgttccg gacgccttt caactgcgac
   901  agcccgccgc tgtccgcca gacgttctc gacacccgg gggccgtca caccgggac
   961  acgacgcgcg cgttcgcgtc gatcgagcag aagctcggcc ccggtcggga ggccgaagtc
  1021  acgcgcgaat accagagcgt cgcttcggaa cgcgtcggt accagagtt tgccgcgatc
  1081  gatccggcga cgggcgccgg cgggccgctg accggcgccg cgtcaccgt cagcagctac
  1141  agccgcagca tcgatcgaa ccgcaggggc gcgcaggc cgtgcgcaag cgtccacg acgacg agagacgaac
  1201  ctgctgttcg gcgtcaacgg cgcaacagc cgcgaacacg agcagcggc agatgaccgc gcccgctctc
  1261  ggcgacgtg ccggacgcc gtgacgtg ccagtgcgac accgctgga tttcgcagaa gggcgtctac
  1321  cccggcatcg gacatcaagct gccgtacca caccaacgac gcacccgtgc cccgatgagc
  1381  ggctgggcc gcatcaagct aggacagct gcgcgcgacg gcaggtgacc gccaccagt caggcgtac
  1441  tggtggaacc aggacagct acctccgtc acgccggcgcc gtacaacccg gccaccagt cacgccgtac
  1501  gcgagctgct actacgtgaa cgcgccgac tgtgtggt gcgccatcc acgcgagcta tgcggagtg
  1561  ttccagcgc agaccaagtc gatgtgggg cgcgggttcg ttcgccgc tgctgaatcc gaaggggcgc
  1621  acctacgaaa cggcgtgaa cggccaggg ccggcaactg agctcagcgg agctcagcg gccgcacctg
  1681  ttccggcgt ggaccaacta cgacctctga caacaacccg caggtcgacc tcgcgatcc cgcggcgggg
  1741  gcgttccga tcactacgtga ctactcggcg gccgccacc tactacctga gccgcttcga gttcgaggcg
  1801  ccgagctgct actacgtgaa cgcgccgac tgtgtggt gcgccatcc acgcgagcta tgcggagtg
  1861  aacgggcgca tcacgcgtg ccggagctg cggggtc tgcgccgc tgctgaatcc gcgccacctg
  1921  tatgcggaca acctcggaa cggccaggcg ccggggaga gcgtgcaaccg cgtcactga cacgccgg
  1981  gggtgcagg tgcagagcag tgcagagcgt cgacagacag cagccagaac gcgtcacgat gagccaggc
  2041  ggctacgcg tcgagccgt ccggccggc gaccgcacc acaagcactg acaagcactg gcggccgg
  2101  ctcaacgtca acaacctgt cgaccgcacc tactacctga gcctgagcc gcccggctgg
  2161  aacaaccgg acgagacg gcgcagccg atgcgccgga atctga 1  mryevreper smmqgatvar fgrwrpslyl glliaahpaa afadaapaag aevrrdkaaa
    61  aqpagselka iavnasrgva ddpsvatvgk mplalreipq sysvttreri dqnlfslde
   121  vmqgsagvtv qpyvlltay fvrgfkvdsf efdqpvvvig dmasapqdis vyerveilrg
   181  anglhgsgn paatvnlvrk rpqyqfsaha tasvgswdry raeadigppl naagtvrsrl
   241  vaayedrhff ydhakqdtrs iysvtevdvt rdtlitfgaq yqtttsvpdm sgvpmardgs
   301  slglsrstfl dtawgrfnwd ttrafasieq klgagwkakv sgeyqsvrsd lkyagsfgai
   361  dpatgaggrl tgaayqfssy srsidanvgg pvhafglthd llfgvtyans ssgmtapll
   421  gdvatgpvnv yrwnpssvpe pqigpyqsq qndvsqdkgvy glgriklaep ltivlggrms
   481  wwngdslgah yntghqftpy ggliwdfard wswyasyaev fqptksmwg ggiltpvkgr
   541  tyetcgvkgel aggkldvsla afridldnnp qvdlahpcag pscyyvnggs vrsggfefea
   601  ngritpwwsv wasytydtmr yadnlanags faplinprhl frlwtnydlp wgerrwsigg
   661  gvqvqssysa qanqvtmsgg gyalasvrlg yrydkhwsaa lnvnnlfdrt yylslsqpgw
   721  nnrygeprnv mltvrgqf
```

706    88    107022421    YP_620748    170

```
  1 atgccacca ccggcgcggct ggcgcggaa gctgggcgt cggggccgga tgaccggac
 61 gcgtgccgg cgatcaacgt caccggcggct ccggccgtcg ccgatccgct gcgccaaccg
121 ctcgaaacgg cccggcggct cggcggcctgcc agtctcgaca cgcgccgcga cgtcgaaacc
181 gtcaggcggcg acacgatcga cgcaccgcg gatcgacga tgctcgacgt ggtcacgcgc
241 acggccggct ttgcgagcgc ggcaggaatc gtgatgacgg ctgctgacg gcgtgcggct
301 ggcttcagcg tcacgttcc gttcgacacg tggtcgtcg cgcgcatcga ggtcgtgccgcg
361 gccgcacga cggtctgta ccgagaacg ctgcaggcgg gcgatcggaa gagtcgccg
421 ggccggcat tcacgttccg agcgcacgcg cgagactga cccggccgcg gcgtcggccc
481 aagcggcgc cgttcgtac gaccgggcgg ctccgccggc ctcgacgcgc ccggtcgta ccggtccac
541 aagcgttcg cgtcgtgaa cggtctcgcc gactcgcgc gagcggcgcg gacgctgtcc ccgttctac
601 gcaagcgatg cgcgtggaa cgttcgcgc cagctgcacg tgacgctga ctacgactac
661 gggcgccaga tgcagttcga tgagccgcg ctactatggc cggccgccg gccgccgcgg gtcgatccg
721 tcgctgccga agtgaacta cacggccgg cgtcgacga tgttcgacga tttcgtacta cgaccagtgg
781 acggccctgt cggccagca ccggccgcg cccgccgtga cgatcacga ggatctgtcga ccagtctac
841 tacctgacat cggcgtcgag ctggactgcg cgccagccgct ccgcggtcgag ccgaggcgcg
901 ggcagccgtcg ccggtcag cgcgttcgg cgggatgctg ccgaagcgca cgaccgtta cccgagcaac
961 cggcgcggcg cggcgttcga ccggaaattca gccaatcac gctccaccgt ttcgtaccgga cgaccgtcgc
1021 acggactctgc gcacgccgct cgatcctggt cgatctgccc agttcacga gccacgacga gaccgctgcg
1081 acggctgccg gcccgcgcac ggcaagccgc cgcggcgcg gcaggcgcag gccacccgg ggcagctggct
1141 cgatcgccg ctggtgag cgaaagcgcg cgaagtcg tcggcgcga gccaacgca gcgacgcgga
1201 gccggcttg cgcggcggc ccgcaaggcg gtcagagccg gaacgccgt gtactaccg tggcagcacg gaaacaggcg
1261 cggcgacctg ctggggtt gtcaaagcgg gcagcagtgg ttgcaaacg gcgcgctgaa gtcgatcctga
1321 cgtgacgag tcgcacaag cggccgcgt gccgtcagc caggtcgatc agtcgacctga acgacccgatc ccgacccgatg
1381 gcgcgccgc acggcccgcc cgttcagg gtcggctcga gccgacgtg cgagccgcgc cgcgatcaac
1441 cgcgcgaaa cggcccaga tcacgaagcg gacggctga cggcgacgct gcggcgcgcg gcgcaacgg
1501 cggagcgc cggcgcgcgg gccgtctgcg agacaccg tcccggcaga cggtcgcca
1561 cggacggtc gcagcagcg ccacgaagc gaggacgcg cggtgctgcg gcgtcgcaa tgccgcgacg
1621 cagcaggga cgatcagcg gccggcgatg gacgtcggtc gcgaacaacg ttccgctgag cgcgtcggcg
1681 cagacgtcg ggcgcggcc acctgtggct cctacgccgg acggtcgac gacccgatcg gcgtcggag
1741 cagacgcga cgcgcggcga acgtgcgcc gcgcggacg gtcgccggga tcgccgagc gccgtcgcag cgatgcggc
1801 gtgcgttacg ctgcgccgaa acgctggct cggcgccgc gatgcgaat cgcggcgcgc gccgcgcgcg
1861 ctggcttacg ctggccgcg tggcgcgcg gccgcgcgc agccgtgggt gcgtcgtga ctgcgccgga acgtgcgga
1921 acggcgtccg atggcgcggct cggcggcgca gcaccgacg ccgctctca tgccgctgat
1981 ctgccaatc tcgcgaaccg cacgtatgcg agacgaacgt tvfdaslrwq ptsrtelay
2041 ctgccggcc cgtcggctc gcggcgcggc gtcgccggga gcgagctcta g
```

```
146

1 mattgalae aaasapddh alpainvtas sapadpltqp letgsrigla sldtpasvet
 61 vtadtidarg drtvldavtr tagfasaiap gtggtalsvr gfsgqesvmt lldgvrlmpa
121 agtitfpfdt wsvarievlr lgprlsyrfy gpasvlygeg aiggvnvvp krpqrtrett lqagvgpdga
181 krfafdttga vpaphgvldp sirklnytvg asdaranglа eradthttai ggalfdvsp qltltldydy
241 grqmpatyyg vpaphgvldp sirklnytvg datisyydqw trlsasyrpa pgvtisnqly
301 yltsnrhwrn aesyvldlat grvtrgdyld ighhqrgigd vftspdptvp qfstrarqaa vfaenrlevl
361 tefsqitfsg tnnspyget tvpahgfdpg aatgagfdkr fanvgwrtgv vfdiapafta yaqyttgaeg
421 prlawvsglr ydhiafsreq aatgagfdkr qweaglkqtl ldgraywtva vyditkrnll stdpfnpalr
481 vgslvtlsas qmnvrlatge vdltggaris hgwtidanva llrarydafn qtvgatvsr agnvpsgvpq
541 qqvgrqssrg vditggaris hgwtidanva vryvgatygd danrvvpsy tvfdaslrwq ptsrtelaly
601 qtanlwlgwa faerwhvnag vryvgatygd ligpsrsael vatmrf
661 lrnlanrtya vtsngeqw ligpsrsael vatmrf
```

707    81    107026796    YP_624307    171

```
   1 ctacagcttc ggctcacgc gcaccacgc ggtaagcccc ggctccgatca ccgcgcgtt
  61 cgccggatag ccgaaacccg cgtgccggc gaggtcaga tgctcggtgt aggccttgtt
 121 cagtacgttg tcgacgcga ccgagattg cacggttg ctgacgttgt attcgtatg
 181 cagcgacagc acgcgaatc ccggcttg gccgaagtcc ttgcgacca cgttgccctc
 241 gttcagccgcg tagcgatgt gggcgcaac gatgcgcac ccgaccccc gcagccgatc
 301 gccgcgcgtg tattcgagc cgatgcgcc ctcgacggc ggcatctgcg gcagcggatc
 361 gccgctcgcc acgttcgagc cacgacacg cggcttcgcc gccatgatc gtcgagcgcc
 421 gaccggccgc cagcaacacg tgcttcgcc gccatgaac aggatgaagt cgcggttgc
 481 ctgcgtgatc ggcccatca gccgacaccc ataggtcgcc cggtcgcgtc cctgacgta
 541 gccgcggtac ccgacaccc atgcatcga cggtcgctc ttgattgcg cgccgatatc
 601 gagtgcgtg gtcttcccg gtgcaccgg cgagaacgc tcgatcgaac cggccggcc
 661 gcgctcgcg gagaacagt cccagatcg cggataacgc tccgcgtggc cgatccccgc
 721 gtaccacgtg acggtagcg acgcgagatc gcgtcgtag cgacgaagc cgtcggcag
 781 caccttcgtc cgatcgtcgt cgaaagtcgg gtccgcttg ctcatcatca tgccgctctt
 841 catcgcgcgc ttgtccgtg cgctcgcata gtcgacgcgc gacctccaca tggtcgcctg
 901 gacgcgctc acaacacgg tcagctgcc gaacaccgc gctcccaca tgtcgcctg
 961 ggcatcccac ggctggtcgc gtagttctg ctgccccatc gacgcacgg aatcgagcg
1021 gttcgattgc gcatcgacgg ccgtagcacg cttgaaatcg tgccgaagc ggaacgtgc
1081 ggggcacgc gcgcgaccg tgcgggccg cacgtccgcg gccatgcca tcgcatgct
1141 gctcgtcggg tcggctcgc gcaacgtga acgtgatcgg acgtgaagc cttcgttgta
1201 gtacacgcgc gcctcgatcc ggtcgagcac gtcgcgccgc atccatcccg cgaacgacag
1261 gcgaacgtc tcgcggcgga aatgccgga tcagctgcgag tcgctatgg cggccgcgt agccagccga
1321 gcgcgcccg cgtccactg tgccccactg cgacgccga gtcggggcc tcgttgccgt tgccgtcctt
1381 cagtccgtcg cgcttccatt tgtcccactg tgcccactg cgttgccgt tgccgtcctg
1441 gtagtccgtg gaatgcgct ggtcgccgt catcagaccg cacggccat tagatcgt gctcgtcgc
1501 ggtccgtcg atgtctggt cgttgccgg gaacgaccg gaacgacacg cggcgagag tgccgtcgaa
1561 gcgcatgccg cgtacaccga aacgcgcgt cccctccacg acgtcgcgca tgccgacg
1621 cgacccgga gcgacgacga cttcaacgga cgttcggtc acgtgaccct tgtcatagc
1681 ttccgggc atgacgagg gcgccggcc tccgcgatc catccgttc gggcacgcgc cggggtcgcc
1741 cattccgttc gcccagcgt tcagccgcga acccgaacatc accgaacatc cggaacatc aatcgcgcc
1801 gtccggttcc ccgctaccgg cgacgcgga tcagcctgaa cctcggatcg gtgacgacga cgagcggt
1861 gtcgctggcg ggcagcgacg ggcgcggcc gccggcgacg cttcggacgg gcagcgacga cgagccgt
1921 cgacccgggc gacacggga cgaccgacga cttcaacggc cggcaacgc atgccgacat ccccgaccg
1981 cgaccgggcc gccggcgtg gccggcgtg tttcggtgtg gcagccgctc ggccgacacg cgccgacg
2041 cagccgagga acgtgagtt cagtacgcg cggcagagge cgcgcagcg cgccgacacg cattcgtgg
2101 cgccgcgg gcacgcaaca ggaaattggt cat
```

147

```
   1 mtnfllrapr aprnagarpl prvlkltvpa lavgalaasa aaaettpaag apsgdaaml
  61 ppvevvaspl stplvvvtdp kaprqpipas dgadylktip gftsirsggt ngdpvlrgmf
 121 gsrinilang mptlgacpnr rfdgslvggs fgrndqnidl esydkvtvvk gpqtvlygpg asagtvlfer
 181 vtprferpgm rfdgslvggs fgrndqnidl vtanhahsqd ykdngntvp
 241 sqwdkwnada algwtpddht rleltagtgd gyaryagrgm dgahfrrref glsfdkrhlg
 301 dvldrlearv yyneadhvmd nytlrqpdpt ssmpmrmaad vrrtvgara aatfrfgddf
 361 klvtgvdaqs nrldsrasmg qnyrdqpwd aqatmwsagv fseltwyasd vsrviggarv
 421 dyasardkra mksgmmmskp nptfdddrtk vlpsgfvrye rdlaslpvtw yagighaery
 481 pdywelfsat rgpagsinaf savqpekttq ldigadyksd rfdawvsaya gyvqafilfn
 541 yaaqmmgpit qatnvnaqim ggeagvswrp vaplrvetsl ayawgrnvas gdplpqmppl
 601 earigleytr gawsagglwr ivapqhryal negnvvgkdf gpsagfgvls lhtqymvskt
 661 vqisvgvdnv lnkaytehln lagnagfgyp anapvmepgr tawrvsakl
```

-continued 708  81  107022434  YP_620761  172

| | | |
|---|---|---|
|   1 | atggtaatg aaagcagccc tagccatcg tccaacgact ctcgcatcat ggttccatc |
|  61 | cgttccacgt atcagcgccg tcccgcgcc gcccgtcatc tgccgcgcg gtcgcccg |
| 121 | gccgtcacgt gctctcttgc cgccggtcg cgggcgtgcc tcctgctgtc ggcactgctg |
| 181 | ccgctgccc cgcgcccga caccgaccg gatgcgcgc cgccacgca cgcgcgtcg |
| 241 | cgtcgggcgt tgacaattcc ggccggcg atttccgcg ctcgaagcgg cgctgaaccg gtcggccgc |
| 301 | gacggggca tctgctcgc ggcgtgacgt tccgaccgg cgttggccg gacggggtc |
| 361 | gtgcacggcc ggtcgacgt gccaccgga cgtggccac acgtgatgc acgtcgcg cacggggctc |
| 421 | gtccgtgg gccgcggag cggccagcc cgcgagttgc cgacgatgc gccgctccg |
| 481 | ggcctgtg gccgcggaa ctatccggg cgaaggaag cggcgtgct gccctccgac |
| 541 | agccgcttgc tgcacacga cgatcctga ctatccgcg gcgcggtc acccgcaac |
| 601 | attccgctgc tgcacacga cgaacctga caatcgcgc gggaacgta gcgcgccga |
| 661 | cagccgccgc gcactccga cgcatcctga ggaacgcct cgcgcgct tccgccga |
| 721 | acgtcgcgg cacgcagga caagatcatg aagccggct caggccgccg ctgcacggc |
| 781 | tcgatcatgc agaacgcat gccgcgtg ttgctgtacg ggctgatga ggcgaccga |
| 841 | agctcgagg tgctgaaggg gccgagtcg ggctgtacg ggctgatga ccgggcgcc |
| 901 | gtcgcaacg tcgtcaccga gccgacgcag cgcaacgcat acacctgat ctcgctcggc |
| 961 | ggtcgacgt tcgggcacgg caagaacggg gcagcgcga cgtcgactc gaccgggccg |
| 1021 | gtcggcgatt cgccgctcgc gtaccgctg atcgtcgacc agtcgaacga acagtactgg |
| 1081 | cgcaacttcg cggagtaccg gcagacctc gtccgccgt cgctccgtg gtacggccgc |
| 1141 | gatacagcag tcgcggtgtc gtcacagtac cgcaagttcc attcgccgtt cgatcgcgg |
| 1201 | accggcctcg accgcgcac caatcgcgca ctcgaactcc cgcacaggc gctacaccag |
| 1261 | gagccgttca acaacatga cggcgaatcg cagctcgcgc aactgagcgt cgatcaaccag |
| 1321 | ttcaacagtcgg actgcagcg cgcattccgg gtgaaggac cgatgccgt cagcaacgat |
| 1381 | aaccagttcg gcaacagtcg gctcgctcag caccgacag tacagtcaca cggatgacgcg |
| 1441 | gcgactcgcg gcgatgcgca cgacgtcag cgacgtcag gctcgctcg ataccgaata cggccgcatc |
| 1501 | acgctccgcg ggatgcggca cgacgtgcag gtcgcttcg aagacccgt cagttatat cgatccggtg |
| 1561 | tatcgcaagg actgctcgtc tcaggccgtg gagacccgt acagctcg gaccgaacg |
| 1621 | agccgtcgg acgcgatcgc gagctacccg gcaagatc tacatcgcgg cgaagaaccg |
| 1681 | ctgcacgatg catccgcgt cttccaggat acggtcaccc acggtcacc tgaccgaca gtggatcgtg |
| 1741 | tcgggcgcc tcccgctaca cacggtcag caggtgcgg ggcggccgg gccgttcgtc |
| 1801 | gcgaacaccg atctcaagcg ctcgaagtg ctgcagtgc tgcgcgcgg ctacaagtgg |
| 1861 | accatgcgt tctcgctgta cggcagtat cgcagtgcgc cggagaagt gtgtcgatc |
| 1921 | gcgcgacga cggcgacgcg cgatcgacgt cagcagacct gcgaggaagc gaccgcatg |
| 1981 | gaagtgggcg gcaagtccgg cttggcgcag cgtgtcgcag gcgacgacg gctgttcaac |
| 2041 | atcgacaaga agaacgtgct cgtgtcgcag tacaacgacg agtctccgg caagctcggc |
| 2101 | cgcacgtcgg cgaagtcgg cgaagtccg agctacccg acgttccgg cgaagaccgg |
| 2161 | gagccgtcga acgtacgga gcaaccagt gtggaaacgtc gcgctcaca cgaaagacccg |
| 2221 | ctgtacgcgg gcaaccagt gtggaaacgtc gcgctcaca gatctgcgta cgtgccgtac |
| 2281 | tacgacttcg gcacggtgc gggcgcgga tccgggaaac agcttccac gcgccgtcc |
| 2341 | gtcgggcgc cgacctacga cacggcaga gcaatcgct cacggccgta gcgtcgtca |
| 2401 | gacgcgttcg cgacttcag cacggcaga cacggcaga agctccgtt ccagccaac |
| 2461 | gtgaagacc tgttcaaccg cacgtactac ccgtcgagcg cgaaccgcta cttcgtccg |
| 2521 | gtcggccgac cgcgccaggt gtccgctgtc gtcgctgtc agtctga |

148

|   1 | mgnesspsps stdspimasi rltyqrrpap arhlprasrp aasgrlarri agavllsall |
|---|---|
|  61 | plpaladtda daapatqras rrafdipagp leaalnrfgr dagillafpp eltaglasgg |
| 121 | vhrfdvdga fdrllagtgl valrqpgggy tlmradgsaa gpvaagvapa aelptidvrs |
| 181 | salraesyra pkeagvlrsd ipildtaqav nivpaqvlrd qrpmlddal gnvsgitqgn |
| 241 | tlagtqdtim krgfggnrdg simqngmplv ggrafnaatd svevlkgpts llyglmdpgg |
| 301 | vvnvtkqpq lvrynvislg astfghghng dtqvavsyqy rkfhspfdrg vgdsrlayri ivdqsneqyw |
| 361 | rnfgeyrqtf vapslawygr qlaqlsvdhq fnadwsahfg ysymrefyda nqlrttgvdp vkgtmtrsnd |
| 421 | epfnmdges ygigyvtgkl tlagmrhdvq vgfdteyrri yrkdllrqav ktpfsyidpv |
| 481 | athgslstds |

-continued

```
541 yglippsstv sasdsdqtdt lhdasaffqd tvhldkwiv sgglryityn qvagrgrpfv
601 antdlsgskw lpragvvykw tdafslygsy sqslkpsssi apmtgyiidg atppeeataw
661 evggklglag gmtgtlalfn idkknvlvsq yndatkltdw rtsgkarsrg veldvsgklg
721 ervnviasya yidakttedp lyagnqlwnv arhtaslaav ydfgtvaggd dlrigadvry
781 vgarpgdsan stflpsyvla dafatydtri gkqklsfqln vknlfnrtyy pssanryfva
841 vgdarqvsll ttiqf
```

709  27  107023374  YP_621701  173

```
  1 atgaacatga aatcgcgac tcgcctgtcc gtattcgcac tcgccggcgc actgctggca
 61 ggctcgcca cgcagcaagg gccgtcggta gccgtcggg ccggcacggg cgcggcgctg
121 ggcgcgggga tcgggcact ggccgtgcc ggcaaggcg ggcgatcaga caagctcgcg
181 ggccactgg tcgtgcgt gacggttac aactgcagg cgatcaagaa caagctcgcg
241 cgtcggac cgcaggcag cacgcaggtc accgaagca cggaacgcg gctgaagctg
301 aactgccga gctcggtac gtccggacg accagtacg cggacacgcg cgatcacgg
361 ccgtcgctga acgacctcgc gacgacctg cgcaagaacc cgcaagtcac ggcgtcgatc
421 gtcggctaca cggacagcac ggctcgcag cagctgaacc agagctgtc gcagaaccgc
481 ggcgaaagcg tcgtgaaccg gtcggcgcag atgccgcgcg tctctcggcg
541 caaggcatgg gcccgtcgaa ccccgatcg gacaacgcga ccgaagccg ccggcacag
601 aaccgccgcg tcgagatcta ctgcgccgcg ccgcaacagc atcagtaa
```

```
  1 mmmkiatrls vfalagalla gcatqgnnt avgtgtgaal gagigalagg gkqaaigagv
 61 galvggvtgy nwqaiknkla psaaqtgqv teqpdgslkl nvpssvtfat nqyaitpaft
121 plindlattl nqpqvtasi vgytdstgsq qlnqtlsqnr agsvvnalvq rgvnggrlsa
181 qqmgpsnpia dnateagraq nrrveiylra pqhq
```

710  19  107021874  YP_620201  174

```
  1 ttactgttgg tagacgagt cggcgcgacg gttctgcgcc cacgatgctt cgtcgtgacc
 61 cgtcgctgc ggctttcct tgccgaggct cacgcttcc attgcgaat cgtcacgcc
121 gagcagtgcc atcgcacggc cgacggcttc cggccagcg acgtgcgagt cgaggtgta
181 ctcgctcgtc cgcgttgt cgtgttgtc ctggatcagc acgtgcgagt gcggtggct
241 cttcagtac tgccgcgt gctgcatcag cgtgagcagc tgcttctcca ccgaatagct
301 gtcgaagtcg aagtagatgc tgccgttccg tgcgttccg tggactgt cagcggatc
361 gacgttcact tgccgacgt tgtcggcgct cgtcggcgt ctgactgcg ccgtgtt
421 tgccttgtcg tcgacttca cgccgactt agccgcgct aacgcgctga tcatcatcac
481 ggccaggg agacgagctt tattcgacat cat
```

```
  1 mmsnkarlal avmmisalaa cksgvklddk annaqavstq psadnvaqvn vdplndpnsp
 61 lakrsiyfdf dsyvkdeyq plmqhaqyl kshpqrhvli qgntdergts eynlalgqkr
121 aeavrramal lgvndsqmea vslgkekpqa tghdeaswaq nrradlvyqq
```

711  24  107022117  YP_620444  175

```
  1 ttagttttgc ggaacgcg tcttctgcac ttgctgcta ccaaccactt cgacttccac
 61 gcgcgggtcc ggtcgaggc aggcgatgag cgttctgcgg ttcttctgt tgcagccagt
121 cgtaaccggg ttgcgctgc ccttgcctgc cggtctgggc cgttgtgcg gcacacctt
181 gctgaccagg tacgacttca cggcttgcag acggcgagc gacacgcgt cgttgtactt
241 gtccgaaccg atacgtccg tgcagaccc cagctttg cttgcgcgc acttccgtg tcatgcctc
301 gatcctcgaa gccaggtcgt ccagtcgt ctgacgtcgt gatcctcgg ctgtgagcg ttgcctgtc
361 gaagtcgaac agtcgtgcg ggccgtgcgg gtcctggc gaccagtgcg ccatgcact ccgagcgac
421 cggacccggc gttccagaacc gtccagccga catcgcccga gaccagctcg ccatgctgga tcgcttggc
481 ggttggccgc gcccgtgtt cccagtgtc attgacgct tgaccgct tctccacac
541 ccattcgccc gtgccgtca cataactgc ggtaactgca ggtagctgca ccgcaccga
601 ctgtccgaa gggatgcag ggggatgcag ccataactgc ggtagctgca atgaacgcga gctttgaaag
661 tttatcat
```

```
712  40  107022082  YP_620409
  1  mnklsklafi aatavmaasa saqsvpasrq avndnwvngt gewwmngtn elcwrdafwt
 61  patanakcdg alvaqapqpp vapvapaits qkityqadal fdfdkatlkp lgkqkldela
121  skiegmntev vvatgytdri gsdkyndrls lrraqavksy lvskgvpank iytegkgkrn
181  pvvtgcnqkn rkqliaclap drvevevvg tqqvqkttvp an 713  44  107026115  YP_623626
  1  msgvfvtaah aqssvtlygl idagitytnm qgghswser sgqingsrwg lrgtedlgg
 61  lkaifvleng fniangtlgq ngrefgrqaf vglsqdqfgs ltlgrqydsv vdyigplsit
121  gtqfggtqfa hpfdndnlnn sfrinnsvky tsvnfgglkf galyfsnsn qfsnnraysa
181  gvsytyagfn igagylqinn dtsgltaaav tnsagavagd ntfvgkrqrv fgglmytfg
241  patagfvftq trvnralgis agasgvssgl gldqtfarfn nyevnaryal tpalslagsy
301  tytagfldgr hpgwmnqfnlq tdyalskrtd vyvqgvyqrv stdglgigay vngjggasst
361  nkqlavtagl rhrf 1  atgaagcacc cgtcatttt tgccgccgcg ctcgtcgcct tcgccgcgcc ggccttgcc
 61  gagaccagcg tgacgctgta cgacgaagct tcaattacac gacgaagtcc gaacaacgtc
121  aactcaatg ggtccggaaa gaccaattac cagctccgga gggctatgc gcaggcagc
181  cgctggggcc cgctggattc cagggccgga gggccgcgga tgaaggccgg cttcacgctg
241  gaaaacggtt tcgagtgaa taacgccagc ccgattctcg cggccgcat gtccgcccgt
301  caggcgttcg tggggtcgtc tgactatctt cgagtcgcgc ttcgccacgc ggcacttcgg
361  gatcggtcg cgtccgacca cgtccacaca cgacaacaa accgggaacg ggaactggg
421  ttctcgacca gcctcgacca cgccaacaca gacaacaca ccgcgtcaa caacaggtc
481  aagtacgcga gcgtcggggc gaacaggctg acgttcggg gcacgtacag cttcagcgcg
541  agacagggct cctcgaacaa cggccgcgta cagccaggcg agcagtattc gctggcgcgg
601  ctgcaggtcg acgggggcg cttcgtggcc ctcgtcaggg gcatcttcgg cgccgcgcgg
661  atctgggcc acgcggcgaa tatacacgga ccgccaagt gcatctcacg ccggggtcgt
721  aattacacgt tcgacgggt gagcccgcgc gacggtcggc agtcgccgg gccttcggt
781  ccgtatcga cgtctacct gggctctact cgagtcgcg agtgctgg cccggcagtc gggcacagt
841  aagtccaga acttcgaaat caacgagctg caacgaagtca cgccggattt cagcgagatc
901  gcgcaatacg tatacacgga cggcaagtac cggcaagtca gatgcggccg caagccgaag
961  taccacacg tcgcctgct ggccgactac agcctgcgaa agcgacga cgtgacctgg
1021  cagggccgt ggcagaggt ggcgacgccc aagacggca cggccccga cgtgacctg
1081  gtccggga cgacgccc gtcggcgtcg tcgaaccagt cgaacgccagt tctcggtgcg cgcggatt
1141  cgcccacaagt tctga
```

```
714   39   107025986  YP_623497
             153     1  mkhpvifaaa laafaapafa etsvtlygvi degfnytnnv nvnqvgktny qlasgyaggs
                      61  rwglkgtedl ggglkavftl engfdvnngr lgqggrmfgr qafvglsesr fgtlfgrqy
                     121  davvdylapl tangnwgtgl fshpfdndnt dnsfrvnntv kyasadwngl tfggtysfsn
                     181  stgfsnnrqy sigaqyslag lqvaaaylqa nnpgigaaga iaaddanfva drlrifgggv
                     241  nyftgpatvg vvytktdvkn pvstvylpas tfagigltat kfqnfeingk yqltpdfylg
                     301  aqyyytdgky daaagsfkpk yhtvglmady slskrtdvyl ggawqkvggd ktgtaadggy
                     361  vvgtdgpsas snqfsvraai rhkf 715   55   107026730  YP_624241
             178     1  atgaacaaga ctctgatcgt tgcagcagct cgctcacgcg
                      61  caagcagcg tcacgctgta ccgctgtgct cgatggctcg gcaatcctca cgttgaaag cgtcttcaac
                     121  gcgcaagt accctggtc gatggctcg gcaatcctca cgttgaaag cggcttcgt
                     181  ggttcgaag acccggtgc cggctcgag gcaatcctca cgttgaaag cggcttcaac
                     241  atcggtaacg gccgcttcgc aaacggcaac ggcggcatgt ctgggtaagc agtttcgtc
                     301  ggctgtcga gccagtacgg cacggtacgg acgggctcg tgggcggca gtcgaagac
                     361  tactcggcgc ctgcgacggc gtcgacggca gaactgctga cgtactccgc gcacccgctg
                     421  aacaacgcg gtcagcagct acgtgagcga acaactggca cgtctcgaa cagtacacg
                     481  agcgtaact acgctggcct gcaattcggc ggtacgtact cgttccaag caacacgaa
                     541  ttcggcaaca accgcgcata cagcggcgt ctgtgtacc gacggtacca agttccaag tctgaagtg
                     601  ggtgcagcat actccgcaag aaacctgggt gacggtacca acagcaacgg cgcatcgacg
                     661  ctgggtggcc aaggccgtgt ccgtacgcg gtgctagca acctgaccg ctgttaccg attcggcccg
                     721  gcacaagtcg gcgtgcatg gacgcaatcg cgtatcgaca cgtatcgaca accaagtcg tggcttccg
                     781  acgtcgcg ctgcaacta cgaagtcaac gcaagtaca aagttcaaca acctgacgc ggcactggac
                     841  ctggtgcg cttacagta cgaacgcg ctacaacgg tcgaagccga ccgagcgca cgcacaagct
                     901  cagtccggcg tgcaagccga ctgcgcgaga gggcaacaac atcgtggca cgggcatcta caacgcgac
                     961  gtgtaccagc gtgcgcgaa gggcaacaac atcgtggca cgggcatcta caacgcgac
                    1021  aacacgacg catcgactc gtcggtcaac caacgcag caaggtcac tctcgtcac
                    1081  cgcttctaa 154     1  mnktlivaaa aasfatvaha qssvtlygvl dagityqsnv ggkslwsmgs gidqsrfglr
             61  gsedlggglk aiftlesgfn igngrfangn ggmfnrqafv glsqygtvt lgkydatqd
            121  ylapltatgs wggtyfahpl mndrlstngd valmnsikyt sanyaglqfg gtysfsnntn
            181  fgnnraysgg lsvyfqglkl gaayssqanlg dgtntngast lgggrvrty gaaagyafqp
            241  acvgaawtqs ridnqaagvp tlradnyevn akynltpalg lgaaytytna kvnngsshwn
            301  qfgvqadyal skrtdvyaqa vyqrgakgnn ivgtgiyngd nttasssvn qtaatvglrh
            361  rf 179     1  atgagaaac ttgctcctcc gaccctccg ctcgcgcgc tggcgcgct cgtgttcac
             61  caagtccagt cgagcgtcagt gtcaaggtaa caattcgtg gcgcgatca gcaaggcagc
            121  ggtaacgatg cgcttcggcc gaaggttc gaaggcctc ggtcgtgta tcgggcgat cttccagttg
            181  cgcttcggcc tcaactcgc gaaggtcca atgggccagca gcgccggat gttccgcgt
            241  gaaacgcgt tcaactcgc gaaggccagca tcggccgca gcgccggat gttccgcgt
            301  caagccttcg tcggccctga aagcgctgac tacggctacg acggctacg tcgcgagtac
            361  gaccccgctg tcgacgtgt caagcctgtt caacaacgac aacactccg cacgcttcgg cagccggttc
            421  gccacgccgg tcgacgtcga caagcctgtt caacaacgac aacactccg cacgcttcgg cgatcaag
            481  tacaacgcgt cgcagccag aggcctccag gcgcagtgg caacagcgg cagcttcg cggccgtgtc
            541  gccagctcga ccgcagagtta cggcaggcc aactaactcg gaaatacgg cgcagttgc
            601  ctcggctcga ctgcaccgg ctgggcccg ctgccggac atcgccgcac cgtccggcga agtgcttcg taccttcatc
            661  aacaacgcgt cgacacaccg ctgggcccg ctgccggac gcaagctccg agtctcaagt aactccagtg
            721  tcggcccgt ctgacgtcgg cacgaacca gaagtacaaca acgggtcgcg aattcgtcac ggatcgaa
            781  tcgggcttcg gcacgaacca gaagtacaaca acgggtcgcg aattcgtcac ggatcgaa
            841  tcgcaccgcg tgtcgctggg cacggtcgac atctacacga gtctcaacg gatcgaaa
            901  tcgcaccgcg tgtcgctggg cacggtcgac atctacacga aggcagcg ccagtacgac ccagtcgac
            961  gccaagtacc accagttc gctcggcgcg ctcggacgc gactactgc gtcgaagcc
```

```
    1021  tacctggttg gcgcgtacca gcacgaaagc ggcaagaacg ccgacgccaa
    1081  gcgccggtcg gctcgtacgg catccgccgc aagagctcgc aggaaatcgt cgactccggc
    1141  ctgcgtcaca agtctaa
```

```
716   58   107022697   YP_621024

1   mkklalstls lallgaagaa qaqssvtlyg vidtsityvh gndqgnnsw smgsgnlqgs
       61   rfgklkgsedl ggglkaifql engfnsasga lgqggrmfgr qafvglqsdq ygtitlgrqy
      121   dplvdlvqav tadnyfgsvf atpgdvdnnd nslrvsnaik ytspvwaglq vealyalggv
      181   agstgkgqtw aaaaaymngp lglaagyfha nnsaplsavg qrtgwagtsd aifdgsgnfi
      241   nnaytsassi giaqvaggya fgpvtfglgy snaqykadan sgftngkyn tgrafvtyqa
      301   saplllgvgh iytkgsgqtd akyhqvelga dyslskrtdi ylvgayqhas gknhadgtdaq
      361   asvgsygiag kssqeivalg lrhkf
```

```
        1   atgtttgcgc tgaatgcacg tgcgcgctg cggcaccgc tcgcgctgc cgcgcgtc
       61   ggctcgccg gtgttcgt cgctcgacg cgccgcgtc tacgagccg ggtccgccg
      121   acctatacgc cgtcgacacg cggcatgccg aaccggccg gcctggat
      181   gcccgctgc tcgacgctg gcatgcgtat ttcaaccgg cggctgccg ggctggatc
      241   gacgggcgc tcgcgaacaa ccgcgaccta cggatcgccg cggatgccgt cgagggca
      301   cgtcgctgt acggccgtca gcgccggac gcgcggaa ccgccgcgt cgtcgatcgc gaatcctcgc
      361   tatgaaaccg gcgcccagta cgaccccgtc gtgcccgaaa gcgacgatcg cgggctgtat
      421   cgcgcgggtg tcgcgacgag cgctcgacag ctcgacccgt cgggcctg gtcccagcctg
      481   tccgagggcg cgctccgcca ctattccgg acggccgatg gtccgcatc ggtccgcatc
      541   ggcgtgatcg cgaagtggc ggcgcgatac gttccgaac gatcgttgc cgagcaatg
      601   gcgccgccc gcgcagcgt cgatgcgcg cgcgcagcgc tcgcgcgcc gcgcgctcg cgcgcccgc
      661   tatgcccgt gcacgagcga ctgccagcg cgcgcgaacgtg aggccccg gtgggtcc
      721   gcgccgcgt cgcaagccg gcgattcgc gcgcagcgc gctcgcagc cgcgcgct tgaacgtg
      781   ctgctgccgg tcgatcgg cctggccgc gcgtgcccg gaaggcgca tcgaacggc gccgacatc
      841   tcgatccgc cgctggccgc ggggcgggt gaaggccgcc aaccgaaca tacggctcgg cgccgcgg
      901   ttcttcccgc gcatccgcgt gacaaccgag cgtatgacga tcgcaccgcg gtttcgaac
      961   ctgttcgcgg ccggcacgag cgttcgcgg gaacctcgac gttgccaccg cgcgatcttc
     1021   gcgggcggac gcaatccgc agaaggcagt gcagaccgg gttccgcacg tgccgatgc gttccgccgg
     1081   gccgaatcg tcgaccgca gcaccagcgt gtcaccaccgc cagcaggag ggacgcgcg
     1141   cggctgaagc tcgggagcg tcgttatgc ggtggtgtcg cgacctatct cgaactgctc
     1201   gacgcgcagc gcagcacgta cgagtcgggg caggtcggg caggaggctga tccgcctagg gccacgtc
     1261   ctgcgaatg cgatcgcgct gtatcgcgcg ctccgcggcg ctcgggccgc gctgcgccag gccacggcg
     1321   gaggccgcgg cttccgcgtg a
```

```
156   1   mfalnargal raplalaaal alagcslapr yerpaapvpa tytpvdggtt paaepataqd
     61   aallddwhay ftdpalqawi vresaisgly ragvqvsaye ldlfgrvtsi ralyyvqrad rmpsvdanlg
    121   yeraqrgydpv vreraqrgly alaqrtldar ermaaltqrr yaagtcsdaie tadaqrtvri
    181   gviaevagay vsersllheql ehaqavralq llagdfarnv pddataldtl lrsaemlvas
    241   arasqaalqr rqaegrlkaa nanigaaraa ffprialttd ygsvsdafsn sqllerrpdi
    301   rqaegrlkaa aggrnranld vaharkdlav aeyekavqta frevadafaa rdwidrqlta fapritlpif
    361   aggrnranld rlklaerrya ggvatylell daqrstyesg qeliriqrlr qddyaadga lgggwapata
    421   rlklaerrya eaaasa
    481   eaaasa
```

```
717   55   107023544   YP_621871

1   ttacccgttc gtcccggttc ccgaggaggg cgcagagagc gccgccttgt cgtagtcgac
       61   cggcgcatcc ggccgcgcg ggcttccg tcgtccaggg gcatcgtgg atccgagccg cgccgagcgc
      121   gcgtacagg tcgaccaggt cgaccccagg cgcaggcgt cgcctgatca gcgactgctg
      181   cgccgagtac agatccgcc agatcccgct gcgcgacacg caccgcgcag cacccgttctt
      241   gtaacgcagg tccgacaggt cgaagcaggt cgaaggcacg ttgctgccgc gttcgtgcc gctcgagcgc
```

```
 301 cggatctgc tgtcgtacg tgccggtgc agtcgtcgt gccggaggcc ggcaggcgc ctcgatgcgc tccgatctgc ttcgcacgt cgggaatgc
 361 cgactggatc gccttctcgt gccttcgat agtcgtcgat gatgcaagt ctcgatgcgc gatgctcg gcggaacga
 421 gaggtcgcg atgtccgtc gatcctcgaa tgaacaagt gcccagtc gggatgtcg tgccaacgc
 481 ccatcccgcc gtgccgct tgaacaagt gccaagcgc cgcaagcgc gggatgat tcgcgttcgc
 541 gccgtcagc gaaatcctcg ggaagacgc gccgaagcg gcgcagcga gatccgacg
 601 ggccagcag gttcgtcgg ctgctcgg gtcaagacga agcgcatgc gcgcggcag
 661 cagccagcg ggcagctcg ctgcagcg caccagcga ttcagcgg cgcggggc
 721 gtcgccgg agcgctcgc cgatcagcga gtcgacatcg acggcgt gcgcggggc
 781 acgggcctgc gctgctggt tcgcgagcgc cgtcgacg accgtctgcg cctgacgag
 841 ctcgagctcc gagcccgtac cgtgtcgaa ctgcagcttg gtcagcgtt acgatgctg
 901 cgcgtcttc agcgtgtcct ccgtgacctt ctgatcagc tcgagcgca gcagctcag
 961 gtattgatcc gccactcgg acaccagca gatctcgcag gctccgcgg catacgggt
1021 cgacaggtat tgccgagcg cctgatcctt caggcctgc acggggcga acaggtcgag
1081 ctcccacgac gcggacaatc caacgtgtt ggtgcgcaa atcagcgcg ccctcgtcgt
1141 cgaacaccg gccggcagc gctgatgtt gcccgtgcc gtaccgtcga gctcggaa
1201 cagcccgca cgctcgatct ggtactcgag acggcgcgc tcgatattga gaccgacac
1261 gccagtcg cgttgtttt tcagcgcgat ctcgatcagc cgctgcagc gcgatcgac
1321 gaagaactcg cgccagccga tggcagcgg cgcctggccg ttccgctgc gcgccggc
1381 tgcccggc tgcgtcggt agacgcgcgt ggcagcagg gcctgcgca cgggtgcgtc
1441 gggccgcttg tagtcgggg ccatcgcgcc agagcgcga ctgcgattgc
1501 agtcaaagcg tgttttgca tcat 1 mmqkhaltai avalfatgct maphykrpda pvaqaypagg vyatqpgaag arsangqaat
 61 aigwreffvd prlgrlieia lknnrdlrvs vlnieaarag yqitraglfp tldqtgtgni
121 qrlpagvstt raplisrtyn vglsasweld lfgrvqslkd qalaqylsta yarqaseisl
181 vsqradqylt lletddllkv tedtlktaqa sydltklqfd ngtgselelr qaqtvvetal
241 anqqararar aqalnalvll igeplpdalp agmpldaqnl ltdvpagips dltrrpdvm
301 qaegtllaan anigaaraaf fpkisltgaf gtaspllgl fkagtaawsf apsialpife
361 gggnianldl ahvqkrieia nyekaiqsaf revsdglaar gtydqqiaal ernehaqgrr
421 fdlsdlrykn gvdsylsvlt aqtdlysaqq slisarlarw tnlvdlyral gggwiqhage
481 aprapdapvd ydkaaapapa satatng 1 ttactcggcc gaaccatca tc tttgctg atagtctgc aggccgatct tgccgatcag
 61 gtcgatctgc gttcgagcc agtcgatgtg ctcttcggtg tcgtcggaa tcttctcgaa
121 gatctcgcgc gacacgtagt cgcgtaccga gttccagtag gcacttcagg cctgatcagg
181 ggactgcgag atctgctcga gttccagtt ccgcacttcagg atcttcgcc tttcctcgcc
241 gacgagcagc ttgccagcag ctgccagtgt ccgagcagg cgagctcga acacgagctc
301 gatcagcagc tcggctgct tcattcgcc tgtacatgg cgcgactcg tcgtattcgt gcttgccgag
361 cttgtcgagg cccagtgct tgtacatgcg cgacagcagg aagtactggt tgatgccgt
421 gagttcattc ttcagttggg cgtttcagata ttcttgtgact ctgcat 1 mgqdkkvley lnaqlknelt alnqyflhar mykhwgldkl gkheydesig emkhadwlie
 61 rvfmldglpn lqdlhkllvg eeteeilkcd lkleqisqst ckealayces vrdyvsreif
121 ekilddteeh idwletqldl igkvglqnyq qtmmqsae 1 tcagccgcc ttgcggtcgt agaacgtgat cgggatcgga tgagcatgat gctgacacc
 61 gccaccggtc gcccagacgc cttgctcggc cgatggtcg cgtacgactt cccgcacttt
121 gcccagcac gtgccacgc cgagctcgaa ctggagttca tcgaaagagt tcacgccctc
181 gggcagggac tgcgggatct gccgatcgga aacagactig cacacgcaga cgatcat 1 mivcvcksvs drkiraslae gvnsfdelqf elgvatccgk ceesvrdlma eqgvcasrcg
 61 vehhahpipv tfydrkaa
```

-continued 720  36  107026550  YP_624061  184

```
  1 tcatgctggc ctcactgaa cggatggtc ccggatgatga gggtgatgga ccggtgacg
 61 gtcaggttga tcaggatgaa tccagcgag aacagcagca cgatccgcct gatcaccggg
121 tagtcgcgga tcgtcaccgc atcgaccagc aggcggcca gcccggcca gttgaacacg
181 gcctgacga cgatcgagcc gcagaggagc gccagcaatg cttgagcacg gcccggccca tcaccgtgac
241 gaccggaatc atcgcgtgc gcaggtcctc gtcagcacc accatcggct cgacacgcc
301 cctcgcgcgc ggggtgcgca cgaagtcggg cgtcagcgtc gtcgagcgtc agccgctgcc agcacgcgt
361 gaagcgcgcc atcagcgggg cgtccggca gccccgaga ttcaccagga gcactagct
421 cttccacgtg cgtccaggca cgagccgcga cgaatacccc gaaatccgcg tgtcatcccc
481 cagcagcatg ccgagcga ggccagcgat tgccacac ggccgacgg atccgatcg ccatccgat
541 gagtcggtcg gccagcgat tgccacac cgccaggcg atccgatcg agcctcccc
601 cgccgtcgcc cacaccagtc gaccacggcc gctcgtcga ccgcagcag gtcggcatga agcgcgat
661 gatccggtc gacacaccgg gactctgcg cccgacagc cgaaatccgc tcgagccga cgtgcgcag
721 cttcacgaag aagtccgaa actggtcgg ggcgcgctt catcgccca tcgagccga gatcggcacg
781 cacgagcgcg accgtcgcgt ctcggcttcc gggccggcc gcgagccgg ccgagccgg ccggtcgcc
841 gggcagcagg cgcgacaac gaacaccag caccgccgac gatccgagcg tggcgcagcag
901 gcgaacacg gcttgacga ggaaatcag cat
```

1 mlnflykrlf glipttaiva vlvflfvhll pgdparlaag peadatval yradlgldkp
 61 mptqfanffv kiahbdfqis trskrpvste igerfmptll ltlvsmvwat aigmaigias
121 avwnrwpdr lgmtiavgsi sfpafalgml lmeifsvklg wlpvvpdgtw ksyylpsltl
181 gaavaavmar ftrasfvevl nedfvrtara kgvhepmvvl kchclrnamip vvtmmgaavr
241 lparrldrrr grvqlagarp pagrcqddar lpgdpgdraa vlagihpdqp drrravrghq
301 pdhpyqvrpa 721  42  107026454  YP_623965  185

```
  1 ttagaagcgg tggatcatcg cgacgccgac tgtcgcttcg aacctgcgcc
 61 cagccgtca cgatcacg tggtccccaa cgatattgcc ttgcgcggc cgtcaggct
121 gttcccgctt gtcgctggt aagccctcaa ccggtggta cttcgtgaaa tcgacaggt
181 gtagtactgc gacacgagt ctggcgcag agcccgggaa ctcgcgatg cttccagtg
241 cgttcgcgga gtgtcagagt gtgtccaag cgcagccaac tgagcgatg cgtccccgg
301 cagcacgcg ccaacgccgg gccagtcgt tgaagattgc cttgttccgg aagaacgaac cgtgcccgg
361 cgttactgg acgtccagt actgacgagt acgaccgcca aatatcccat gccggtgta actgacgca
421 cgcctcacg cggataagct tggtgcggcc actgcggatt gcgcgtgcg tagccgtgt tgatcgacga
481 gactgccgga cggtgtgcg tgaaaaatg tggtccgatc cgccgatgct tttcgacga tcgagttgc
541 gccccacacg gccccacga cgtccgagtt gttgacctc gttgacctc gtcgacctc ccgatgcc
601 tgccgggccg ttcaggtact cgaaacgagt acgaacgcc gatccgcgc gctccacgtg gatcgatc tcgcccgc
661 gtagacgcg gagtgttcg cggcagcc gtgtatccac gaatcgatat cgcccggtg
721 cgacacgcg gagccgtc gccaggtcgt cggcagcag cgcggcagca gcgtagta
781 cgccgtag tgccgccgg cgtgacgcg acgcggcgg gcgtggtca ggcaaccca
841 cggtgtac tgggtgacg gtgaagatgc cggtgcca cgctgcgag cgtccgacg tgttgcgcc
901 ggcttccaac tggaaaatcg cttcgtgcc gccggacga tctcgagcc cttccaggcc
961 gggcctccaa tggaaatcg cttcgtgcc gccggacga tctcgagcc cttccaggcc
1021 gaagcggctg cctgcccaca gccggggaa catctgcacc ttcgagtgac caccgggat
1081 tgccgcggcaat gccgcgagt t ttctgcca agcgataccg ttgcgcagg taccgcagag
1141 ggtccacgcg ctctgggcgt ggcggcggt agggcttgcg agaccgactg ccgcatggc
1201 gaaagcgacg cgctttttca t
```

161

1 mkkrvafamt avglaaataa haqssvtlyg ivdnglawqn nssavgatsg ghskvqmstg
 61 vwagsrfglk gsedlgggtk aifqleagvm giftrqawvg tnatygtlt
121 agrgytayyt llspysptw ltgyygahpg didsldtsyr amnslvymsp kfyqftvggs
181 ysfgvagat nrgstwsaai qylngpagia vgyqkvnnst lgggvwgans tvqngltaag
241 dgnqpavssi mngyataqsg qriavtagyq ftpawdisas ysnvqytpgt gsfirnkaif
301 ntagavlhwk aaaqwdfaag ysytaatqsn gitssakyhq vtlsqyysls krtglyavea
361 yqhasgntln grgnaiiisat tsigdgvgag skqnqigvgv gmihrf

```
723   85   107022089   YP_620416              186

1 atgtcgttca ctttgccgc gcggcctcg cggcgccggc tcggctcgc ctcgcggcc
      61 gctttcgcat ggcggccgc tacgcggct gccaccgacg atgtccgcgc cgggaccgcc
     121 cgcgcggtg ggtgcgatcg ctcccgcacc actgcgaacg ccggcccggc tgtcgccggc
     181 gtgcggcag cgtccgcacc cgcggccgat acgctgagcg ccgtgaccgt gaccgcgca
     241 cggcaaccgg tgaccgga tacgccggcc gtcgtcacgt gcgctcaagt acgcgccgaa caattacgcg cctgatggtc
     301 gatgcgcata ccaacgtcac caccgaggac gcgctgaagt gcgctgcgga gtcgcgactt caacgaactg
     361 cgcaagcgct acatcgtgtga ccgcaacagc ctatcgcgg ggcgttgc tgtcgaacct gctgggtcg
     421 cagagcgcgc gcgggctcgt ctatgcgcgg attccgcccg acgaatcgc gcggtcgac
     481 agtatgcat accgcgcg ctggtcgtg cgggcaacg cgatccggtc cactgtgtg
     541 gtgtctatg gcccttttc cgcgctctat cggcggtc cgagcagtt ctttacgcag
     601 ctcaccacgc gccgccgga acaactcgag agtccgctgt gcaatcacca gacggcgcgg
     661 cgctaccacg acggctaccg ctttgccgg agcttcgcgc gcaatcacca gacggcgcgg
     721 atcgaaacc gtcgggccg gtctgttc gtctgtcgc tcgaccgtcg ggagaacaac
     781 ggcagccga tgcagtacg gggccccaat tcgacctaca accgcaaact gccgccccc
     841 gtgccggtga cgggcgccgc gaccgacatc ggcccaacg cgaagccgcg gacatcgtc
     901 gcggcagag acggctagage gaccgaacag ctcaacacag cgttccggat gggctatgcg
     961 ttcaccgatc agctcgatgc gacgtgacg ctggggcgg gcaatccgg ctgggcat ttaccggcag
    1021 cacggcgaga cttcctgcg agatggggcg gtccggcg aacgcgtcg cgccgaccag
    1081 atcggcggcc agaacatgac gcagcggcc tgatcgcg gacgtgctg cggcgtca
    1141 gagaactggc tgtacgacga cggttgaac gcggtttaaac ttccgctg gcggctgag
    1201 ggcgtcgtgt cggcgtacga cgtgtcagt caaggcgcgt ggacacgct gacgctgaag
    1261 ggtgggcggg gcacgcgtgt ccaggcgca aggtcatacg gcgacgt gctatcacta cgaaactac
    1321 gcgcagcgc agtcactga caacaccgga actcagtcg acctcctgcg gctatcacta cactgcgctc
    1381 ttcctgcgca agtcactga atcccggcg caacacgacg actcagtcg tgggcagga cgctgcgt
    1441 gcgacgtct atccggcgca cacgcagcgc cacgcacgcg caggcgtgt tcggcagga agctcgctg
    1501 ttcgcgcgc gtggcgcgc gcgcgcctg cacacgcgg tgggcgcac agccgcgg acaggcgc
    1561 ggcgcgctcg gcaatcgcg ccgcacgca gtggaacgca gcgaggttcg gctgtccag tccgacacaa
    1621 tgcgcgaaag tgccgcgtcg cgggatgcg gacgaacgcg acgcacgacg agggcaccg ctccacaa
    1681 gcgaccgtca acaacaaccc gacgttcct gaattgtcc ccggaacgg cgatcgacty ggacttcag
    1741 gcgatcgtca acaacaccgg gaagcggtg gacccagcg tattccagag cgatcccgc
    1801 gcgaacgcg acgtgggcgt cgggccagag acgggtgcg gggcgacca ccgtcaccaa cattccgaac
    1861 gactcgatct acagccagag tgcgctccga cgggctgcaa ggcgcgagaa cgtcgggtg
    1921 gtcgctgcc tgccgcactg gaacgtcacg gcgagctga gcgcgcaaacg cgcccgatgc cgctgcgcc
    1981 cgtggtcg atctcgacgc ctacgtccg ttccgttc cgagcagcg cctgcatg cggaacctg
    2041 gcgaacccg cctacgtcg tccgcttc cgagcagcg cctgcatg cggaacctg
    2101 ctccgtcgt atcgcttcga acagcttga caacacgcg gtgaatccg cggtccgc cgagcagcg cggtcaggc cggtcaggc
    2161 cgccgtttca acagctca caacagctca caacagctca gtgaatccg cggtccgc agtcacg cggaacgac
    2221 tcgttcacg tgtcgatct gaagccgcg gaccgccgc tatcgttcg atcgtcactg gaccgcgc
    2281 gcggcatcg acaacgtgac gaccgccgc tactacccgt tcacccgta tcgctgcg
    2341 acgtctatg gagaactgaa tggtcgctg tga
```

```
                                                    162

1 msftfaarps rgrlalacaa afawpaayaa atddvrragta rggvdrppt tataapaaag
      61 vaaasapagd tlsavsvtaq rqpvdptpa vvtsitreqi gvllsnllgs alkyapnlmv
     121 rkryigdrns ifagrdfnel qsarglvyad syayppprwsl ippddiarvd
     181 vlygpfsaly pgnaigstvl lttrrpeqle alstqfftq ryhdgygfad sfggnhqtar
     241 ianvgrfwf alsldrlenn gqpmqyagpn stynpklgaa vpvtgaatdi gpngkprtiv
     301 gaqtierteq lnetvrmgya ftdhvdatlt lghwenhyrq grldsgwrls gnpvyggnvs
     361 igggmtvap nafapqrgdq enwlyalgln ftfgyhydny dviraastvq
     421 ggagtlfggd gtwrtldlk aeapvvkght ftfgyhydny flrnvtynta dwlagpttsl
     481 asvyrgdtrt qalfgqdawr faprwlatlg lryerwdayg galgnargtl gyadrganal
     541 spkvalqwda tevwrfrlsf atgtrfptvg elfqgtismn aivnnpnlr pekaidwdft
```

```
601  aerdvgvgvv rasvfqsdlr dsiysqttvs gattvtnisn vdrvvrgve lafsgenvgv
661  rgldldanvs asnaqilada anpayvgsrf pripmranl lasyrfdehw ltsvgvrysg
721  rqfntldnsd vmpdvyggts sftvvdlkar yrfdrhwtas agidnvtdrr yytfhpypgr
781  tfygelkwsl
```

724  78  107026278  YP_623789  187

```
  1  tcagaactg gtgcgcaatc cggccatcag gcttcggccg cgaagcccgc
 61  cacgccgac gtcgagtagc gaatctcctg gtcgtcagg ttgtcgccgc gcagtgggc
121  gagccagtgc gtcgggccga ccggaattt gtacgccga atcacgccga gcgacgtata
181  gcgtccgtc gagaagtcgt cgtcggcac gcagctgc gaccacgcgt gctgacctg
241  tgcgcgcgca ccgaacggc cgtaacgta gtcgcccgc tgcgtagt gcagccggc
301  gatcgcggc agcggctgcc gtcgtcgac gaacgcacgc cactgccgt ccagctcgac
361  ttcgagatcg accgtgaa ccgcgcgca gttgaccgt gatcgctcg cggcgtcag
421  gccgtagaac tcggccgca ggccgtccac cacgccgcg ttgagcgag cgtcagtgcc
481  gggcgacg ggctcgccgt ctcgtccac cacgccgcg gtgtgtact cggtcagata
541  gttcgagaag cggttgtaga acacgccgg ttcgccgcgg tcgggttgc cgatcaggaa
601  cagccacag tcggtcgaca cggccttc cttcagcgg ttcgggttgc cgatcaggaa
661  ctgccggtc gcatcgtgcg ggccgttcga atacagcgg tagaaggtcg gcgcgttc
721  ggtaggcg acgttcgtg cgatcgacca ctgcgccc gcgaattct cgagccgcc
781  cgaggctg tcgaccttca cgtcgtcgaa gcggcgccg aggccagct tcagccgcg
841  cggatcgga tcgacctca cgtcgtcgaa cgcgaacag cgcgcgcctg ttcagcccg
901  gacgcctgc catcctccga ggccgaacag cgcgacgtg cgcgacacg tggacggcac
961  gagcatttcg tgccgacg cgagaacgt gttcggccg aactgcagc cgatcgcgcc
1021  ttcgaacggc cgatcctgc gatggggtgc gcctcgtaac gcctagtgc cgcgattgcg
1081  gaagtgcgtc gccgctctgc ccctgttgtc cttcctgtgg gcctagtcgg tgtacgcgaa
1141  atcgaattc agctcgtga acgccccgct caggctgcc acctgcgcg cggaacgcag
1201  gcttcctgg cgcatccgca gccgcacgtc gctccccgc agcgagccgt agttcgattc
1261  gtaccgctg tacgacagc ccgtcgaaac gtcgcaccac cgtgacgacg cgccgaccgc
1321  acctgagtcg gtggccaca cgcgtccgct tccggttgcg gcccgtcggg
1381  gccgcgatc gccgctcgt gcgctctgcg cgcatagccg ggaatccgca gctgctgct
1441  ttcgcgatcg aaccgctga cgtggaagca cgtggaaccg ttgccgcctt cgacctggt
1501  gggccgcgcg tccacgaat tcgccccgc gtagccggcg tcgagcgcc ccgtcatgcc
1561  ttcgatcgct tcgcgcaga tccggttgtc gatcgggtg accaccgtt ccaccgcgtt
1621  gccgcgcgta agccgccga cggcccg cacgatcg acgcgctcga tcgacagcg
1681  gtcctgcggc accgcgtgat cgtacgacag cgacagcg tcatacgctg cgacgcgtt
1741  ctgcagcagc cgatccggt ccgccccat cccggatg atcgggcggc cgaccatcgg
1801  ccctagtg gtgtcgaca cggcccag gtttcgagc gttcgccga gcgaatcggc
1861  ctgcgcccgg gtcgcagtc cgccgaaag ctgccgacc gtgcgatca gttcggtgtc
1921  gccagcgcgg ttccggtca cgaagatcga cgcgagcggt ggggtcgc gcgcaggcgt
1981  gccgacccg ggggcgcat ggtctcgcg atgcgcgacg aggcgcaca gcatcagca
2041  cagggacgag acggccgca cggtaagtg agggagctcg cgcatggtcg gtgaatcggt
2101  tgatcgcga tgatcggata acgacgccg cgggctactg cttagatcga tatattgttg
2161  cgtaactgac gcgcagtgac ccgttggaac ccggtcggc aaggccggg cacctggttg
2221  gaacggcat
```

724  163

```
  1  mpfqpggral pshvptghca svtqqylvsn sdphrslsdh piptdsptmr dlphlplrpl
 61  ssislmlcaa vahaqtdapa asgtpaaapa plapifvtan plgdteliap tvqlsgdalt
121  rrqadslget lnglpgvstt tygpmvgrpi irgmdqdrir llqngvaayd asslsydhav
181  pqdplsierv eivrgpaall yggnavggvv ntidnripre aiegmtgald aryggansvr
241  agaaqveggn grfafhvdaf dretsklrip gyarssqqra idgpdapqpe gnvpnsdgrv
301  hqgavgasyt wadfagllsy sgyesnygsv aesdvrlrmr qerlafasev rnlsqpftkl
361  kfdfaytdyr hkevdnqeta ttfmrgyea riearhrkig ggrfehvkvd pdpagvekfa gqntfsalgd
421  emlvpstrtn svalfglew qvvpalkisl ayteraptfy elysnqphda tgqflignpn askekavstd
481  slsagalfsl tpwsianv
```

-continued

```
541 lslryasgpn rgsvgvfynr fsnylteynt grvvdddgep vaptdgsln eaiyrgvrae
601 fygveldgkw rafsrrghtv dieltadyth arnvdtcgpl priaplratl aadygygpfg
661 aragvthaws qhvpdddfs tdgytslgvm ltykfrvgpt hwlahlrgdn ltnqeiryst
721 svvrgfapqg grslmaglrt tf
```

725 43 107023546 YP_621873 188

```
  1 ttattgcgcg ctcgacgcg cggcagcact cggccggatg gcgcccggcg cggcacccgg
 61 ggaagcggca gggcgccgg acccggcagc cggccgcgcg cgggggcag cggcacccga
121 ggcgcatcg gccgcccgg cagctgacg ggcgaccgtc ttcacggtcg cgccggcgcg
181 cacccttgtcg agccttgca cgatcacgtg atcgcccgcc tgcaccccgcc cttcgacgat
241 ccagttctg ccttgcatgc cgtggtcttc cagcggacgc ggctcgacct tgtcgctggc
301 gttcaccacc atccgatcg cctggcctc ctgctcctc gatccggcca tccccggcag
361 caggaaggcg ttccgatca tccgcctct cgccttcgcg gatccgaaca tccccggcag
421 cagcacgcg cccggttcg gaacaccgc gcggatcgtc accgagccga tgtctggtc
481 gacctcacg tccgagaact gcagctgcc cggctccgag taggcttgc cgcttccag
541 gatcagcga ttcagccct cgccgggcg gtctgcttc agacgcccga tctgcacgtc
601 ctgacgcagc ttcacgccg gtcgacatca ggctgacgctca ccggatcgag
661 ctgctcgag cggcgtctg ctcgacacg gctcgcctgc acgtatcgc ccggtcac
721 ttgcgagatg ccgacgcggc ccttcgcgg cgacacgacg tccgcggcct cgaggttgat
781 ctgcgcggta tccgaccgcg ttgtcgtagt cctcgcgtgct gaccgcttc ggccttcgt
841 ggcgaccgcg ttgccgtct agccgcgttc gctgcctgct gtcccacca gcaccttgta
901 gcgcaccgcc agccgctct ctgcgacgag gtctccgcg gccttcgca gcgcccctt
961 cggctgttcc agccgccga tgtacgcg tgaattcacg cggatcgagc gctgaccgc
1021 ctgacgtcg gtgccttcgg cgccttcgg gcgccagcacg gccagcacca cccgcgcacg
1081 cactgcgcg acgaggaatg ggctgtgga cactgggcag gccgtgaaga ccgtacgg
1141 ttgcggctg acgtgacga cgccagtcg cgccgactc ccgcgtttgg ggcgccggtg ccgattctt
1201 tttcccgcac gggccagga aaacgccggc cgtcgcgaca gtgattaagc ggtatggaac
1261 ccgttcgacg cgcat
```

164

```
  1 mrvervpyrl itvataavfl aacgkkesap ppqtpevgvv tvqpqavpvf tdlpgrtsaf
 61 lvaqvrarvd givlrrefte gtdvkaggrl ykidpapyia alnsakatla kaqanlvtqn
121 alvarykvlv aanavskqdy dnavatggqa aadvaagkaa vdtaqinlgy tdvvspisgr
181 vgisqvtpga yvqasqatlm stvqqldpvy vdltqssleg lklrqdvqsg rlktsgpgaa
241 kvslilledgk tysepgklgf sdvtvdqttg svtiravfpn pgrvllpgmf vrarieegvn
301 enaflvpqig vthdqkgqai amvvnasnkv eprplkttgm qggnwivegg lqagdhvivq
361 gvdkvrpgat vktvaaqlap paapaaagsg aaaasgaaaa gaapasaaaa
421 ssaq
```

| ID | MW | Protein GI# | Protein Locus# | SEQ ID NO: | Sequence |
|---|---|---|---|---|---|
| 801 | 81 | 161524767 | YP_001579779 | 212 | Bmu17616-800 |

```
  1 tcaccagtta tatttccgg tgccgatcac cgtccggtcg ttgccgaaca tgcagaccga
 61 ggtcgactga caaccgctga tgtaacacg ttcctcgcgt tcgacgcgaa tcgacaccgt
121 gcgccagttg cgccagtcgt aatgcacgc cgtctcgtag agccgtagc tcgacaccgt
181 cagccagttg tcggacgacg agctgacacg cagtcggac cacacgaccg ccatctggcg
241 gaagcccgcg agcgccacgt tgtccacgt accagtgtt cagcaggtc tcgtcggcg
301 cggccgcgga atgtcgaccg acgtcgatcag cgacaggttc cggtggcct gccgacctt
361 gctccctga tacgccgtacg atccccgcgg cgtaaccgc accggattcg tgccgccgg
421 cagcagccc ggcagcgtc ggcagcgcg ggtcctgag gttggctgg ttgatctgat agatccggg
481 atccgcgtc aggttctgc ccagcaccc cgggccgcag caggccgcag cccgcctgcc
541 attcagcatc ggtcggcg ttccgccacc ccgcctctcag cgcgatcg ttgatgaaaca
601 gccgctcggc gaatacgag ctgatgtacg gcgacaagcc gtactaccg gcggcacgcg
661 cgtccagtag ggtcgcccgg cgacagccc gatcaagcc ctgatgatcg gatacgctga
```

```
       721 gccgtaaac gccgacagt cggcctcga ctgcgtccg gccgcgggt cgtccatcg
       781 catgtgacc cagccctcgc ggccgccgag cgtcagcgag cagccggttcc acttgattcg
       841 gtcctgacc tacaggccga acgtgttcat ccgtcgtac cggtggtgc gtacgtggt
       901 gtccgatcg gaaaacacgg ccgtcgtgac acgtgccgtc accggttgt agaggttcag
       961 cgtggcgcg gggcgagcc attcgtatc gcggacccgt ggtcccgtc tggccggttgt actggaagcc
      1021 gagcagcagt gtgtgcgga ctgtagtca tctgggaacgg cgcaaaacgg cgcctcgagt tgtgtcagt
      1081 gtcgaaggg ctgtagtcga cccaaccga gccagtgtcg acgacagat cggtcagcgt
      1141 ttcgcaggc aagccgctc acatcgagtt caggtgtgc tcgaactgat gcaccatcg
      1201 cgttctgc cggaactgcc acatcgagtt cggagtgaagt gccgccgct tcgaactgat agcgagcga
      1261 ccactgcttc ttgcggtagt agtgaagtt gcgaatgct tcgagatgt ccttcgtgat
      1321 ctgccgttc ggattcgca acgtggcca tggcagcgca aggaagttcg acgagatgtc
      1381 gcccgttcc tgcagataca tggccgacag cgtcagcgaca gtgtcgggc tgggcgcca
      1441 gcgaacgac gtgcgagcg acgcgacga accggctc atcgttgttc gggccggtca ccgcgttgcc
      1501 gtccgcgcg agcctcgatc atgaactgct tgcgtcgta gtactgccg gctgtccgca cctccgcac
      1561 gacctcgatc atgaactgct tcgtctcac gtcgacacgt gcgaccggca cgcccgcgcc
      1621 cgctcgagct gctacttcac gtcgacacgt gcgaccggca cgaccccgc cgcgccgcc
      1681 gtacagcacc gactcgggc cggcagcac ggtgatcgct tcgacatgt acggatcgac
      1741 gccccagtc gacaggttca cgtaccagtc caccgaggc cgttcacgt accggtcgg
      1801 cgtgaagcg cgagcgccg cgtaccagtc gaagcgttg tccagccgt acgacgaaaa
      1861 gcccggaccg tagccagcg cgtgtcac ctcctcatct cgatctgcg
      1921 cgcgtcacg acgtgatcg tctcggat ctccctcgac ggcgtcggg tcttcgtgcc
      1981 ggtccggctg cgtccggctg cagccccgac cgtccgacg gctccggct cgcattcgc
      2041 gggtatcgcc gtctgagctg acgcccgtgc gcggtggct tcagctcggt gcgaatgct ggcattgc
      2101 cgccggccgtg gtctgcagcga acgcctgcc tgcgcaggg gcggcaggg gcaacgaatg ccacctcgc
      2161 cgccgccgcg atcgcacga ccgccgtgcc tgtgcccaa tccat 1 mdwatgtrlr aiaaaasvaf gaaaagafa qttpaanaga aapnaaasagt lpaitvnaas
       61 egdgtvglva krsrtgtktd tpieeipqti nvvtaqqiem tgatdvmtal ryvpgfssyg
      121 sdnrsdwyaa lrgftptayv nglqvpntln lsswrvdpym idsitvlrgp tsvlygagdp
      181 gaivdvktkl adgervreag veignyarkq fmidvgkld pdgkyayrfv gvardgnavt
      241 gpmndqrval apsfrwrpna dsltlsaty lqdwgdissn flpaagtvlp npngqitkdi
      301 yegdgnfnyy rktqwslgyq fehnlnsmwt frqntrwmhl svdngsvwga gfadetltei
      361 nrwagvfqmn ysrfdidhnl egrfatgplq htlllgfqyn rqtatdsewl aaaptlnlyn
      421 pvtpvttav fsdpdtyrt ntyttmtfg lyaqdqikwn rwtltlggre dwnmrmodr
      481 aagtskadv saftgrvglt yqagygllspy isystsfnpi igvslldggv pkptrgrgie
      541 aglrwqppgk nlmlnaalyq inqtngvrtpa lptqdpgtk svqtgevrar gielsatgkv
      601 tpnlsliasy ayqdvkvvga ndatlnmwpv diprprqmas lwadwtwhtg plagfglggg
      661 vryqsasaga adnsltvssy tlidaavhyd vrnwrfavna tnlfnrhyis gcqstsvcmf
      721 gndtviata kynw 1 atgcttgagg acaacaagat ggacaacatg cacaacacaa acggcctgat gccgatcgcg
       61 aagtggcgg cgtgtcgg gctgctcg acgctgctcg gtgggcccc gacgtcgca
      121 gactacaagc ccgggacgt cacgagccc tggaagcg ctcgaggc agaagcgcc gacgctcgca
      181 ccggcgagc aggtccgga acctgaggg ggatcccgtg ctcgagcgg gcctgggc gcatcgcggc
      241 gaatgtgga aggctgctgt agctgaaggc cggggccca tcgaggaaca aggcgccgcg
      301 gcgaaccgga cgaaccgcg ccagtggtt ccgggccca ccagtggtt aggcccgcg tcgacgcgc
      361 actccggcgt cgctcgtcg cgcgccgcgt cgagtggtt ggcgccgcgt cgctcgtcg
      421 ctccggtgg gacccggtt ccaggccgag ggcgccgcgc gacccgacg gccgaaaggt
      481 cgccgtcgg gaacccagg gccgcgatc atacccgacc gacccgagg gcgcgaacgtc
      541 gaaggctcgc gccgccgcg agtccggca gaactactc gctgggccga gcgtccgtt gcagctcgcg
      601 ctgacccg cacgaggcg agtccggcag gtgccgcgag gaactcgagg gaagctgctgc ggatcaggac gcggcggttc
      661 ctgtaccgcc gcacgtgga gtgccgcga gctcgacgtg tcgcggccga gctccgtgca gcccggttc
      721 aacgaaggcg acatcaggcg agtccgacgct gaacgagct agaacgagct tgcgtccgcg 802    55  161519924 YP_001583351
```

```
 781 cagccgatg cggtccgcgt cgcgcgccgg cgattccgcg cgaacatgc gtccgcgatt
 841 ctgtccggta agccgccggc cgccgggatt gccgtccgt ttcaaggaaa cgccgctcgt gccgcgtcg
 901 gtgaagattc cgccgggatt gccgtcgcgc cggatccgga ctgctccgga cgtcgcgggc
 961 gccgagcgtg cgatggcagc acatcaccgg atcgttcgga tatgaagcgt cgacgctcgg cgcgatttc
1021 ccgaagctcg acatcaccgg gccgcacgtt ctgctccgga cgtccgcgg gaccgcgtt gacgctccg
1081 ctgtcggtcga gcgacgcg gcgacgcgcg cgcagccgg cgtcagcagg cgtccgcgca gtacgacgaa
1141 ctgttcgacg actatccgga cgcagtcgcg gcagtgtcc gtccgtccc cgcaggtcga ggacaatctc
1201 caggccgcga actatccgga gcatgttgc cgatcagatt ccgcgcaga atgccgcct caatgcgtcg
1261 gccgatctgc ggtgctcga cggacgcag tatcaggaag gcgaagtcgc gtatccgac
1321 cgccgtgcgg cgaagctgtc cggaacgtgc cgtcagttgc aggcgaatca gctcacggt
1381 gtgatcgata gtgagcggtc cgtgcactg caacctcatc cgtgcactg gtgccgggcg gggagggg
1441 gcgcagccg tgtcgaccgt tgcgagcgg gccgggcgcc aaggcggaga tcgcggggcg ttga
1501 ccgaccggg tcgacggcgg 190
   1 mlednkmdnm hntnglmria kvraaastlla tllaacavgp dykrpdvttp aafkeaptla
  61 pgeqagtwkp aepadgahrg ewkvfgdpv ldaleegala anqnlkaaaa rveearaatr
 121 tarsqwfpqv gvfgptreg lssasqfcpq gtgptnatlw raqgtvsyea dlfgrvsrnv
 181 easradqaqs ealfrsvqla lqadvaqnyf elrqldsdq lyrrtvelre ealklvqrrf
 241 negdiseldv srakne1asa qadavgvarr raasehalai llgkapadfa fketplvpva
 301 vkippglpsa llerrpdvaa aeramaaana riglaksayf pklditgsfg yeastlgnlf
 361 lwssrtfllg pfagtaltlp lfdggrraag vqqaraqyde qvanyrqqvl vafrevednl
 421 adirlldgi raqnaavnas rraatlsrtq yqegevayld vidsersvlq slqanqltg
 481 aqaystvnli ralgggwea ptavdgaaaa kaeiagr 214
   1 tcagtagcgc gcgtcagcg tgacgaacgc ggagcggccc ggcggatcg acgcgtagtg
  61 cgccggatac gctgagcttc tgttgatgc agtacgtcga gttgaacagg ttgttcacgt tcagctgcag
 121 gtccgagctc tgttgatgc ggtactgcg catccgcatcg aagccgcatcg acgacggcac
 181 cgccgcagcg acatccggat gccgcagca ttccgcgaac aagccgcgct tagaacgcgc acgacccgac
 241 cgtgaacttc ggcctgacgt cgcagttgaa gccagtcgt gccgcagtgt aagcgccgt tcggcgtatt
 301 cggaaagcga tgcgccggca tgcgtgtgt cgcgtgtg cttcgtgtg cctgcagttg cgtccttcat
 361 gtactgtag cgcgtagcga gcatagtcgt tgtgcgcga cctgcactg tttcgtgagc cgcccgcga cgtccgagctc
 421 gaggccctgc tgccgacct tgttgcgga ggaacaccg gcccaccgg ttgttcggca gcgtcacgcg
 481 cgcgtcgtc gtatcgatct cgatcgcag gcgctagcc gacacttgt cgtcagcac
 541 gtccattc gtgccgacct cgatcgcga gcatgtcgcg gtctctccg gccgactgt ggtcggctt
 601 cgagccgacg cgccgccggc cggccgtc agtacgtga cgactgtc tgtcgcctt cgcgagcag
 661 catccggcc cgctcgacg atcgccgt gccgatag atggccgat gtccgcgg tctgcgcgg
 721 cttgaacacc cggccgcag gccgagttga caggcgcg cgacgcatcg aagccgcgt aggcttgcc
 781 gccgtccgcc ttgtatcg tgaagccgcg tcgagtcgt cttccgtg cgacgcga cgccgcag
 841 gagtgccag gcgccgcga tgccgatcgt gtccgaagcc tttccgagc tagatcgact cgtcgcgt
 901 gcgcatgc gcatagtcgt tgtgcggca gatgaaacc gcccacggat cggcacgga cggccgggtt
 961 cggcagcgca aggctgcc agtcgtagcc ggaacgggc cggatcgcgt tgtcagat tgttcagat
1021 cgcgccggtg cggtccgcga cgtgctcgcga gtctcgcgttg gtcgcgcgtg acccattcgc gcacagcgc
1081 gatccggtc gtaagctgt gtgaactgtt gcggtcgcgg gtcgtgttg tgggccgcc acacttccgt
1141 ctggttccg atgtccggc ttgtcgtga tgtcccgtg ctgccgcgg ccgcgccc aggtcggcc
1201 gttgatcacg ttgtcgccgg acccgacagc tcgaactgct atgtagtcc tggtctgcc
1261 ggtagcgc gtcgtgtgc gacgtcgcc gacagcagcg gatcgacagc atgtcgca cgatcgcag
1321 cgtctgatg tcgacctcg tcttgggaa gtccggtcg gcttgttcg tcgtcgtga agaagttgtg
1381 gaagtacgga gtcgcaag atgccggat caggccgcg gatcgcgt gcttgttcg tcgtcgta
1441 gcgcatcgga gtccggga agccaggt agccagcagg agccacgcg agatcagcc agcccggt
1501 cacggcgtc ttgtcgccga atgccgaac cgcgacgcc gatcgacgg atgtagtcc agccgcgtt
1561 gttcacggcg tccgacgcg ctttgggc cccacgtcgt gttgcctc gtcgtgtct cgatcgcag
1621 cgcatgatcg cgcgaactgcc agtgccgtc gcgtgaag gcgtgttcg tcgtcgta gatcgcgcc
1681 gagccggccg ctccggggg cctcggcgg agtcgacggt cgtcgcgcc gccttcgtga tcaggtgat
```

803 84 161520344 YP_001583771

```
-continued
1741  gctgcgccc  gcgccgcgc  ggccgcgta  ggcgccgtcc  cgcgccgtcg  tgatctcgac
1801  gcgtcggtg  ttgaagatt  cgcgccggt  cgccgcatgc  tcgccgacga  cgtcgacgaa
1861  catgctcggc  tgcctgcga  agccgcggat  gaacgggcgg  tgccgaggg  ggttgccgcc
1921  ttcgccggcg  ccgaacgta  tgccgcgagc  ggtcgcgagc  gcttcggcg  gcgccgaggc
1981  gcgctcgtc  tgatcagct  cctgcggaat  cacggtgacc  gattcggcg  tgtcgacgag
2041  cggccggtg  aatttggccg  acggcggat  atcggccttg  tagctgtgct  caggcggcc
2101  cttgatctcg  atcggccga  gatggcttc  cgcctgcgc  ggccgggcgc  gcggggcgcc
2161  gtcggcggc  aatcggggac  cggcgggag  cacgcgcac  agggtggtga  atttccgag
2221  cttcgactcg  tcggaacggg  acttcat
191     1  mksrsdeskl  gkfttlcsvl  aagpafaadg  appapadae  ghlapieikg  raehsykadf
       61  sasakftapl  vdtpksvtvi  pqeliqtsga  stltealrtv  pgiitfgaeg  gnplgdrpfi
      121  rgydtqgsmf  vdgmrdtgat  treifnterv  eitkgsdgay  grrgaagssi  nlitkaphlg
      181  ttaaasaglg  tdryrrftad  gnwqfadhaa  frlnlmshnn  dvaqrdavmn  erwgvapsia
      241  fglgtptrvt  asyyhlstdd  lpdggipyfy  tttnkpanvd  tiypapvdrh  nfyylidrdf
      301  rkttsdistl  riehditpal  tvrnttryte  stqdyiwtqp  ddsqnving  kvwrrmnrn
      361  ssinsianqt  elfgefrtgp  fkhsfftgie  lsrewgkrdt  ytvatgtgai  cmngigapsg
      421  ynctslwspn  padpwagsis  rrnndyahart  ttksiygfdt  ieltprwqln  agvrvddyst
      481  rftdtkangg  ktytrddtlf  nwqlgavfkp  agngsriyasy  atsstpagml  lgegsetqsl
      541  tpgrgvgsn  adqlspeknr  sievgtkwnv  lndklsltaa  lfqidttnar  vtlpnnqyam
      601  vgnkrvqgle  lgvaggltkg  wqvfggytym  kselrdngkd  tannghrfpn  tpkhsftmwt
      661  nydvtpkftv  ggafymsev  fgdpanlrav  psywrfdama  qyrinkkldl  qlnvnlfnr
      721  tyfdqaypah  yasiapgrsa  fvtlnary 215     1  tcagaaatcg  acctccatgc  tgactgcgac  ggcgacgtat  aggcgtcgag
       61  caccggcgag  tggcatccga  tgccggcgca  gtcgaccag  ttcagtgaca  tggcctcgaa
      121  caggtgcgg  atccgacccg  cgcgctccac  gtgcttgttg  aagcgatagc  cgccgcgcag
      181  atcacgacaa  acgacgactg  tcgcgatcg  cggccgcagc  ggcgctcgc  ttcgaacagt
      241  gatgccttg  tcgccttcg  tagccgcacg  cggcctgaa  cagcagatcg  gtctcgaaca  accagcgttc
      301  ggtcggctg  tagccgcgg  cgaacacgga  agaaacgga  gccttcagc  ttcacggtgt  tgaagcggctg
      361  gctccggcg  cggcgttc  ggcatccgag  gcgtcgagcc  gccttcgatg  cgtgaaacg  tgccagcgt
      421  gatgccgttc  ggcatccgg  agtccggccg  gccccgatgg  cgggccgatc  cgccgaacg  cgccaaccag
      481  gaagctcacg  tactggaaca  cgaacggatc  ggtcggccg  ggcctgttt  tgccgaaccg  cgatcgtcgt
      541  acgccgatg  aagttgcgt  agccgcggt  gaacgccgcc  gccgtagc  gtgtcgctgg  gaatcgtcgc
      601  gtagccgtg  ccggccgcc  cggcagccc  ggctcgaac  gcttcgaca  gtgcgctgg  tcgagaaagc  tgctgttgac
      661  cagtgcgga  ttgccgatcg  tgcctgcgt  aatagaactg  cggcgactga  cagtgcgtg  ttctgagcc  agccgaggc
      721  ctgatccga  gtcgcgcaa  aggcgtaat  cggcgacgaa  gcggtcgcgt  gcggtcagca  cgcctcgt
      781  cgatcctcg  tacagcaccg  cgacagcgg  cgttcgtacg  cgacagtcg  ttcgctgcg  tcgaaccgc
      841  ggcccggtg  aacagcggat  gtgccggct  cgtcgcagc  gccgagcgt  cgaagcggcg  cgaagtgtt
      901  ccccggcg  atcgagcagg  ccgatccgag  ggcgctagcg  gatctgatcc  tgccgaaacg  cgccaacag
      961  cgtgagccg  gtgctgctg  gtccggggt  aggccttgtt  cgccgacgt  tgccgaccg  cggcacccgt
     1021  gcctcgcgc  agttcgtga  tccgcgacag  gctgccgtcg  gccaacgcg  acgccgcca  acctgtgtg
     1081  cgcaagcggg  ccggtcgaga  atccgcttc  ggcaacgcg  gagccgcca  cgctttcga  actggttc
     1141  gtcctagcgg  ttgtcgcgg  ttgccgacgg  cagtgcgcg  cagtgcgg  ttctcgaacg  accgtactg
     1201  gtccccgaca  gctcctcgt  aatagaactg  cggcgactga  cagtgcgtg  tctggcgag  agccgaggc
     1261  gtccgtcga  aagccgtaat  cggcgtaat  cggcgactga  ggcgctcgt  tcgacccggt  cgctcgtcgt
     1321  gaggccgagc  gtccggctg  cggctgctcg  cgagtcgtc  agatagcacg  tcggtcgcca  cggccggtcg
     1381  gacgcgttcg  ggctcaccc  cgtgtcaccc  gtcagccgc  gtccacgtg  ggccagca  cggttcgga
     1441  gagccgcgt  ggctcgtg  cggcgctgc  cgtccgtgt  gtccgtctgc  gtccgacgcg  tgccgcggaa  tgcctgcgga
     1501  gtgttcgctg  ccggcgtgt  cgttgccgcc  gatctccgag  cggcgcccgt  accggggc  cgtcgacgga  tgatcatccc
     1561  cttgatgcga  tcgttgccg  cgcggaacg  agaagtaggt  tgaccgttgg  tagatcgaca  gctcggtcga  ggtcggtggtg
     1621  atccgagctc  ggccgaacg  gtccggcacc  gtcagtccg  cgctcgtgg  tcgacgccgt  ggcttcgacc  gcagttcctg
     1681  cggatccttc  gtatgaagt  gtcagtgaagt  tgaccagtc  cggcagtcgt  tccgcagtcgtt  acagcgccga 804  83  161519887  YP_001583314
```

-continued

```
1741 cgcggcccg cgcacgatct cgatgcgctt cagcgtatcg agatcggtgt agcgcgcg
1801 gccgcctg agcggccga acgagaatgc gtcggcagg gatgccgt cttccatcag
1861 catccgcga ttgccttcga ggccgcggat gttgatgctc gaatcgccgt cgggccgcc
1921 gccagacgcg gcgttgccg gacggtagc ggtgccgcgc accgtgatgc cggtcgta
1981 gcgcaaggcg tccttgatgt tggtgcctg ctgtcgtcg aggtcgtccg cgtcgatcac
2041 cgaccggaa gcggcggtgc ggtccgcgcc cgtccgcgtg cgctcgccg tgacgtgac
2101 cggtcgagc agccgcgtgc tggccgccgc ggctccgcgg tcgccgtga cggacgagc
2161 ggcggtgtg gacggcgaag aatcggcctg agccgctggc ggcgacaatc cgaccggcc
2221 gatgagcgcg gcaaagatcg gctggcgcgc cagcgtagag cgatgcac
```

192

```
  1 mhrstlargp ifaaligavg lsaatahads spshtaassv tadaaaaras salldpvtvt
 61 atrtataasr taasvsvida ddldeqqatn ikdalryepg itvrrtayrp gnaalgggrd
121 gdssinirgl egnrvmlmed girlpnafsf gpleagrgdy tldtlkrie ivrgpasaly
181 gsdgltgavn fitkdpqdll siyhkptyfs frpsyastdr sigatvsaag gndriqgmli
241 adgrgheid trgsnnsagk lrttsnpqhv yseslgkllv lptvrdtir ltaetvqrrv
301 gtdvlsaiva patlgltsd rlernrfsad yafhddasrw lgnahvgfyy qeatqdqyaf
361 etrgtlpsrs rdnryrertf ggsafaesgf stgplahkll ggvdgslsri tnlrdgtvpg
421 vgetfpnkaf pdtdytlfga fvgdqigygr llvtpglrfd tyrlkpsgnd pltgravst
481 hanelsprva vlyeiapali pylqyahgfr aptpdqvnss fsnpvqgyts ignpnlkpet
541 sdtfeaglrg ragtvgtir ysaaaftgry rnfiarttia gsgrptdpfv fqvnfadar
601 vhgiegradw ampngitlrt alaltrgstq ndgaasqpln tvmpfsavfg vryepterwf
661 vqtdllfqaa krdkdidrsd cskracfapp ssfvvdlrgg yrfnkhvsat vgirnlfdrk
721 ywnwsdvrgi aadspvlday tspgrtvavs mkvdf
```

216

```
   1 ctacagcttc gcgctgacgc gcaccaggc ggtgcggccc ggctcgtga ccggcgcgtt
  61 cgccggatag cgcaagccg cattgccggc gaggtcaga tgccgcat aggccttgtt
 121 cagcaggttg tcgacgccga ccgagacctg cacggccttg ctcacgtgt actgcgcatg
 181 gccgcacgga gcgtgccg cccgagccga ccccgaagtc ttgccgacca cgttgccctc
 241 gttcaccgca tagccgatgt gcggcgcaac gaccgccac aaaccgcgc ccgaccacg
 301 gccgcgcgtg tactcgagcc gacgcggc ctcgagcggc ggcatctgcg gcaacggatc
 361 gccgctcgtc gcattgcgc gccacggcta gtcaaccgag gtctcgatac gcagcggtgc
 421 gaccggccgc cagccgcgc cggcttcgcc cgccatgatc gtagtcgcgc tgcgcgtcgc
 481 ccgctcggc gggccatca tgccgctcgc gtagtcgcaa aggatgaagt cctgcacata
 541 gctgcatac gggagaccc acgtgcgag ccgatcgctc ttgtactgcg cgccgatgtc
 601 gagctgcgtc gtcttccgg gctgcacgc cgagaaagcg ttgccgaac cggccggccc
 661 gcgttccgcg gaaaacagct cccagtagtc cggatagtcg tccgcttgt cgaaccggcg
 721 ataccaggtc accgaccagtc acccaggtc gcgctagcgc gcaggaaggc gtcggccag
 781 cacgcgcg cgatcgtcgt cgaacgtcg gttccgcggc ctcgtcatca tcgtccccgt
 841 cgtccagcgc ttgtcacgg gcctgcgcata gtcgacggc gaaccgcgcg ggttccaca gcacgggtgc
 901 gaccgccgc gctaccacg tgaccctcgc catagtcctg ccgccaccg aggatgaagt tgcgccgcg
 961 ccgcccac ggccatca tcagttctg cgccacacg ttgaacgcg tggccgcccg aatcgacg
1021 gttcgattgc gcgcgagcg gctgcgacg cttgaacgg tcaccgggac gccaagcgc tcgcgatgct
1081 ggccgcacgc gcccggcgac tcgagcgc cacccggtga gttgtccatc agtgatcgg ctcgttgta
1141 gctgcccgga gctgagccg ggtgagccgc ggtcggcaga tgccgttgt cgaacggacg
1201 gtagcggtt tcgcggcgga gtgagccgcc gtcgccgcc gtccatccg cgccttgt agccgcgta
1261 gccgaacgtg gtgccgccg tcagctccga gtcgccgcc gtccatccg gcccgcgc tgccgccat
1321 gccatccgcg gtcgcgtccc tcagctccga tgccgcacc gccgtggtc acgtcccgag tccagcccgc
1381 cggctcatg gcgtccatt gcctccgat gcccgtcgcg tagaaatcgg tgctcgcg
1441 gtagtcctga gcatcgcgt gattcggat gcccgctcg gaacgaccg cgaatcgcgg tgccgtcga
1501 cgtcctgcg acgtctgt gctgtcgtc gcgcgccgt cgtcgacacg tgccgtcg tgccgctcg
1561 gcgcatgcgc cgtacacaca gccgctcga cgccgcgcg aacagcacg tgccgtcg tgcgcctcga
1621 tgccgcgg ccgtacacaca cgctcgcg cctttcag accgccact tgtcgtagct
1681 ttccggtgc atataggag tccggttc catccggttc ggaacagcgc cgagcgtcgg
```

807 81 161521211 YP_001584638

```
1741 catccgttc gcagcacgt tgagcacgga gccgaacatg gccgggcagta cgggtcgcc
1801 gtcgttccg cccgctcgga tcgacgtgaa gccggggatc gtcttcagat agccggcgcc
1861 gtcgctcgcg gacgcggct gccgcgcggg cttcgatcgg gtgacgacga cgagcggcgt
1921 cgacaacggc gacgcgacga cttcgacggg cagcaacagc gtcgaccggcg atgccggcgt
1981 tacatccgcg cgatgtcgg gggcgttcgg cgcaagtt cagcagccgc gcggccgtcg cgtcagcac
2041 gccgcggtc agcgcgggaa cggcagttt cagcatcgcg gccgcggcc gcgcaggc
2101 actgggcgac gccgggcgc tgcgcaacga aaaatggtc at 1 mtifslrtpp appsacarpa prmlklavpa ltagvlsata aaadadapah radvppdtpg
 61 mllpvevva spistplvvv tdpkaprqpl pasdqadylk tipgftsirs ggtngdpvlr
121 gmfgsrlnvl angmptlgac pnrmdaptsy iapesydkvt vvkgpqtvly gpgasagtvl
181 ferttprfer pgmfdgsvv ggsfgrndqn vdvtagtpdf ygrvianhah aqdyrdgngr
241 tvpsqwdkwn adaalgwtpd vhtrveltag tdgyaryag rgmdgahfrr dtfglsfdkr
301 hlgdvldrie arvyyneadh vmdnytlrqp dpasempmrm asevrrrtlg araaatwrfg
361 dafklvtgvd aqsnrldsra amgrqhygdq pwdaqatmwn agafgeltwy aaeaarvigg
421 arvdyasard krattggmmt srpnptfddd rarvlpsgfl ryerdlaslp vtwyagigha
481 erypdyweli sakrgpagsv nafsavqpek ttqldigaqy ksdrldawvs ayagyvqdfi
541 lfdyasgmmg ptrasnvna qimggeagvg wrpvaplrie tsvayawgrn atsgdplpqm
601 pplearvgle ytrgawsagg lwrvvapghr yavnegnvvg kdfgppsagfg vlslhaqynv
661 sktvqisvgv dnlnkayae hlnlagnagf gypanapvne pgrtawvrvs akl
```

808    81 161525105 YP_001580117

```
  1 tcagaactgc agcgtgtca gcagcacac ctgcgcgcg tgcgcgatcg cgacgaagta
 61 gcggtcgcg ctcgacgggt gcttgacgcg tgagttgaa acccgcgtcg tccttcacgt tcagctggaa
121 cgacgcttc tgctgcaga gtgaagctgt gcccgatc gccgcggcgt gcgccgacat agcgtcagc
181 cgacgcagc gacacgtcgt cgcgcgatc gccgcggcc gagcgccgt gcgcgtacc agtcgcgag
241 tacatcggg cgcagcgatg tgacgcggtg tgcccacag cggttcgcg cgtgcgcccg gatcctcgat
301 cgacggtg tgatgtacg cgtccacag cccttgccc ccggtgtcg ccctggcg gatcggcgg
361 cgtcttgcg tgagctcgg cgcgcgacgc cgcgcgagc cgggcgtcc cgcttgcc gacgcggcc agtcgcgca
421 cgacgtg agctcgcg tcgttgaact gcgagacgag cgtcagcag gacgttcttc tgtcgatgt cgaacagcgc
481 cttcgtccg ggtgcgc gtcgcaggtc gcggccggtc cgtcgtga cacgttcgcg ctgtcgatgg acccgtcgc
541 gagcgtccc gctgatcac cgtcgatcgg cgcgcgagc gagctgccg gccatcggc gccgcgacga
601 ctgtcccgg cgtgcgggg agcgccgga gtacgcgga aagcatcgg tccacttgta
661 cgcagcttc agcagcctga aatagctcg gcgcgcgt acagccgtg acagcccgt acacggatc
721 gacatgccc gcgcgcgca gccagcgcga ggttgtacgt gatatgccg agacgatcca
781 ccgaccgcg cccgagacct agatgaatcg tgtcctgaca aaacgcggac cgcgtcgtgca gcgtcgt
841 cttgtcggtc gtgagtcgt gctgaagctg ttcctgaca acagccgt gcgcggatc
901 ctggtcgtca gcgaactgga gtactcgta gcaccaccg cagccgta acacggcgta
961 gactagctg aacgcgtct tcaccgcctg cgcagcatg tccttgcga agatcggcgg
1021 gtactcggtg tcaaggccga ctgcacgtg gtgccacggt tcagcttgcc
1081 gttcacgtag cgatcccgt agcgtcggt gctcagcgag cgtgcgtcg cgtcgttgct
1141 ggcgacagc gtaccgtca ccggatcgca gccgctgt ccgcctcagc tgcatcgta
1201 ggtttcgcgg ttgtagctgt agccgaaatg cgcggtccag tcccatgttg ttgaacggct actgcgatc
1261 gacgctcagc tgggcgagat gcgatcgcgt cggccgcgt gctgcgcga ctgagcgccg tgcccgatcg
1321 ccgccgcgcg tggaatcgga tggaacttcga gcggcgga gtgcgccgga cagcaccgta tgccacgta
1381 gaaccgatcgt gcgactcgta gtactccgta cgacaccgta acctgccgta ccgcacgca
1441 ccaccgagc gacggccgca cgaaggtctg cggtattcg ccggaaatgc gccagtactg
1501 ctcgttcgac tgtcgacga tcagccggta cgccgtcctt ccggagccgc tcgccccggt
1561 cgaatccgac gtcacgtgc cgccgtctgc ccgccgtctg cggagccccg cgccagagcg
1621 aaccgcgttg tagccgtag tgacgtggg gctgcagcg ctgtgcgacg agttgacga cgcccccgg
1681 gtccatcgc cgtacagca gcgaggcgg cgcacagcg acctcgcag accctcacg tgcatcgc
1741 gggcgttgaac gagcgccc gcacgatcgg tcatgatcgt catgcgctg tgcctgcgtg agccgtcg
1801 gttgcgccg aagccgcct ctgacgttgc tgagttgctg tagcgcgacg agcgttcctg
1861 cgtgatgccg gtgatgccg ctgacgttgc cgaggtggtc gtcaggttgc gtcgcgatgc ggctcgcgcag
```

```
1921 cacctgcgcc ggcacgcgt tgacgcgct cgcgtatcg agcacggga tacggcgcg
1981 cagcacgccc gctcctccg gcgccgta gctttgccg gcagccgcg tgtcgcac
2041 cgcgatcgtc ggccgttcg ccgcgttcg cgcatcaac gcgcacgcg gcgcaccgt
2101 catgcgttc ggccgttcg cgccgttcgc gcgcatcgc gtatagccg cggccgactg
2161 acgcagccgg acgaggccag tgcccgag tgcggcgcg agcgcatcgt cgagtcgaa
2221 gcgccgtgc acgccgcgc tcgacaggcc acggttcag gcggccagc tcaggcgaa accgatcag
2281 caggccgcgg tcgcggcga accggttcag cgtcgttcg ggcggccag agcgccgcg ccggcacgtc
2341 gaatcgcgcg cgcgacgcg ggcgacgcg gcggccgcg gcgcgacgcg tcggtgccg catcgcgag
2401 cgggcaac cggcagcagc cggacagcag gacgcagcg gcaagccggt gcgcgacgcg
2461 gttcgcgcgc cgggcacga tcgtgccgcg cgtggccgg ggacgccgcc gacggccgcc
2521 cggcatgaga cggatggaaa ccatgatcga gaagtcggta aacgatgggc cggtcggct
2581 ttcattcccc at 1 mgnesrtgps ftdfsimvsi rlmprrrpas arhtrtrivp aapnrvahrl agavllsall
61 plpaladadt daaaaaprts rrafdvpagp leatlnrfgr dagilliafpp eltaglssgg
121 vhgrfdvdda larvlagtgl valrqsgggy tlmrangang angmsgaavp apsadtaael
181 ptiavrssal raqsyrppke agylradipv ldtaqavnvv paqvlrdqrp rnlddalgnv
241 sgitqgntla gtqdtimkrg fgdnrdgsvm hngmpivqgr sfnaavdsve vlkgptslly
301 glmdpggvvn vvskpqltr ynayslgast fghgknggsa tfdstcpiga srlayrlivd
361 qsneqywrnf geyrqtfvap slawygrdtq vvvseyrkf hspfdrgtal dprtnapldi
421 parridepf nmmdgeshla qlsvdhqfna dwsahfgysy nretydanql rtttgvdpvtg
481 tlsrsndath gelstdsygi gyvngktla gmrhdvqvgf dteyrriyrk dmlrqavktp
541 fsyvdpvygl lppsstvsas dsdqtdalhd asaflqdtih ltdkwivsgg vryitynqva
601 grgrpfhant dlsgsrwlpr agivykwtds fslygsysqs lkpssiapm asgyvidaat
661 ppeqtawev ggkldlpggi tgtlalifdid kknvlvsqfn datkltdwrt sgkarsrgve
721 ldvsgriger vnviasyayi daktiedply agnrlwnvar htaslaavyd vgtlaggddl
781 rigaaaryvg arpgdsansf tlpsyvlada fatydrlgk qklsfqlnvk nlfnrtyyps
841 sanryfvaig darqvslltt lqf 1 ttactggtgc tcgcgcgcgc gcagatagat ctcgacgcgg cggttctgtg cgggccgc
61 ttccggtcga tgtccggcga ccggtccga ccagccgtt gacgacgctt tgccgcggt acaggcggtt
121 gcccgtcgacg agcccgtgca ccagcccgtt gtcgtgtagg cgatcaccg agcgctcac
181 cgtccgttc agcccgttc tgttcccagc cgtcgttcagc agcggcggc agcgccgtcc agcggcggt
241 ttgccggttc tggttcgtcg gaactgac gtcgttcagc cgagctggc acgtcagct tcagcgagcc
301 gatccggtac tggtcgacct cgtgacccgt cgtgccagcc ctgcccagcc agcggcca gcttgttcct
361 gtccggctgc cagtgtgatc cgtccaccgc ccgtccaccg gccgccagcc ggccgcgca cgcgcgat
421 gatccgcttgc cagtgtgatc ttgccgcgc ctgccagtgc tgttgcctg gccgatgcc cgcaccgt
481 cgccgcgccc acgccgcgt tgttgcctg gccgtcgt ccgcgaggg gcaggggcgc
541 gccggtgccc aggacggcc aagacggaca agcgggtcca gctccatg ttcat 1 mmkiatrls vfalagalla gcatqgnnt avgtgtgaal gagigalagg gkgaaigagv
61 galvggvtgy nwqaiknkla psaaqtgtqv teqpdqslkl nvpssvtfat nqvaitpaft
121 pllndlatti nqnmpqvtasv igytdstgsa qlnqtlsqnr aqsvvnalvq rgvagnrlsa
181 qgmgpsnpva dnsteagraq nrrveiylra pqhq 1 atgaccacaa ggagagtaac catgatgtcg aaaaaagttc gtcggccct ggccgtgatg
61 atgatcggcg cgtccgcagc gctgcagcc ggtgtgaagc ggtgtgaagc ggcaaacgcc
121 ggtgcggca gcacgcccag gacaccgcag aacgtcggcg aagtgaacgt cgatccgtcg
181 aacgatccga acagcccgt ctgcttcgac cgcaagcgc agcatccact tcgactctg cagtattcg
241 gtgaaggacg agtatcagcc gtatcagcc gctgctgcaa agtatctgaa gagccacccg
```

809 27 161524037 YP_001579049

810 19 161525757 YP_001580769

-continued

```
301 cagcgccacg tgctgatcca gggcaatacc gacgaacgcg gcacgagcga gtacaacctc
361 gcgctgggcc agaagcgtgc ggaagcgctg cgccgcgcgc tgcgcctgct cggcgttgcc
421 gattcgcaga tggaagcgct aaggaaaagc aaggaaaagc cgcaagcgac gggtcacgac
481 gaagcgtcgt gggcagcaga ccgccgccgg cccgcctcct accaacagta a
```

196

```
  1 mttrvtmms kkvrlalavm migalaacks gvklddkana gamstqpsad nvaqmvdpl
 61 ndpnsplakr siyfdfdsys vkdeyqpilq qbagylkshp qrhvliqgnt dergtseynl
121 algqtraeav rralallgva dsqmeayslg kekpqatgbd easwaqmrra dlvyqq
```

220

```
  1 atgaataaac tttcaaagct cgcgttcatt gcagtcaccg cagtccgct tgcatccgct
 61 tcggcacagt cgtgccggc gtcgatgaa cgtcaatg agctcgtc gggcgacgg gaacggcag
121 ggcgaatggg tgtgatgaa cggcacgaa gagctgcgc gcgagctg gggcggcgg gttcgacg
181 ccggccaccg ccaacgcgaa gtcgacggc gcactgtcg cccagaacg cgactgccc gcacgcgcg
241 gtcgctccgg tgctctcgg catccagagc cagagatca cgtatcaagc cgacgactg
301 ttcgacttcg acaaggcgac gtcaagcg ctgggcaagc agagctcga agaagctcga cgaactggct
361 tcgaagatcc agggcatgaa cacgaaagtg ctgcgcaa cgggtcgcaa cgaccgatc
421 ggttcggaca agtcaacga cgtctgtcg gccaacaag atctacacg cgcaagcgt caagcgcaac
481 ctgtcagca aggtgtccc ggccaacaag cagagagaac cgcaagcaac ctgatcgct cctcgcaccg
541 ccggtcacga cgggctgcaa cggtgatgga gtgttcgt acgcaagaag ctcagaagac gaccgttccg
601 gatccgccg tggaagtgga agtggtcgt aggtcagtca a gtgaagaag gaccgttccg
661 gcgcagtaa
```

197

```
  1 mnksklafi aatavmaasa saqsvpasrq avndnwvngt gewvvmngtn elcwrdafwt
 61 patanakcdg alvaqapqpp vapvapaits qkityqadal fdfdkatlkp lgkgkldela
121 skiqmntev vvatgytdri gsdkyndrls lrraqavksy lvskgvpank iytegkgkrn
181 pvttgcnqkn rkqliaclap drrvevevvg tqevqkttvp aq
```

221

```
  1 atgaaaaaga ccctgatctt cgccgggcgt tccggcgcgt gcgcggcgca caacgaggca
 61 agcacgtca cgcctacg gtgatcgaa gacgagcgg gccgatcaa cgtatgaa cgggtgcgc
121 ggccacacgc cgtgcgaggg acctcggcgg cgagagacgg tcgatcaacg gcgcttcgg
181 ggtaccgagg acctcggcgg cgaactgaa cgaacgcgg gcgattca gcctcgaga cgcttcggg
241 atcaacaacg cgaacacgca gcagaacgc ctcgagttcg agcagcagge agtacgacag cgtcgtcgac
301 ctcgcacaca cgggttcgg ctcgtcgcg ctcgcaagcg cagcacga agtacgacag cgtcgtcgac
361 ttcctcggcc cgtgtcgt gacgggacg caatctgtc cggatcagca atgcagtca gtatcaaagc
421 ttcgacaacg acaacctgaa cacactgaa gttcggcgca caactcggct tctcgaattc gaccgattc
481 gcagacttcg gtgactgaa cgccggcgaa cgcctacggt tgtacgctt tcatgggcct caacctcgcg
541 tcgaacaacc tgaactgaa caacaactcg cgcaatcc aattcgtcg gtctcgcgg cagcgatccg
601 gccgcctaca cggccagtg cggccgactg gacgttcgg gcaagcggc agccacttg gggcgcgcc
661 ggcgcagtg cgcagtg gttcgggcc gcaaccgg ggcttcgtgt tcagcgagac gcgctcacc
721 cctcaactacg cgttcggcc gcgccaaccg cggccaatcg gggccatcg ggccagge gctacggge
781 gatccgaac gatcggcgc cgatcggcc gcaaccgg gcacgacgg gccagccgc ggccacttcg
841 gacacgcgct tcaacaacta cgaattgaa caccgacgc cgatcggcc cactgacgc ggcgttctg
901 ctcgcgggct cgtcaaccgt cgtaggccga ctacgcgct cgcaggcgct cgaagcgca tctgcagggc
961 cagttcaacc tcacaacctg cggaacg cgaacctg cgggcaacag cgggtcggca ccgatcggc
1021 gaataccagc gcgtgaacg gacgctctc ggctacgacg gaacatcaa cggcctcggc
1081 gtccgtcgt cgaccaaca cgcaatcgcg gtgaccgcg gcatcgtca ccgcttctga
```

198

```
  1 mkktlifaal sgcaaahaq ssvtlyglid agitytnnqg ghsawqetsg singsrwglr
 61 gtedlggglk aiftlengfg inngtlkqng refgrqafvg lahsfgslt lgrydsvvd
121 flgplsltgt qygtgfahp fndnlnmsf risnavkyqs adfgglkfga lygfsnstdf
181 snmraysvga aaymqlnnni nslalaasdp gavagdwtfa asrqrtwgag
```

```
      241 lnyafgpata gfvftqrlt dsagieaggs gvsggiplt  dtrfnnyeln aryaltpafs
      301 lagsytytdg rmegqkpswh qfnlqadyal skrtdlylqg eyqryngdgl avganinglg
      361 vasstnkqia vtagmrhrf 813 44 161520585 YP_001584012  222
        1 atgaggaagc agtcatttt  tgccgccgcg ctcgccgcgt ttgccgcgcc ggccttccgg
       61 caggacagcg tgacgctgta cggtgtgatc cggtgtgatc gacgaggggct gaactacacc gaacacgtg
      121 agcgtcaacg cgccgggcaa gccggattac ggggcggccga ggcctatgc gcggcagc cagggcagc
      181 cgctggggcg  tcaagggggga caggatctc ggaaggcgt  tgaaggcgat cttcacgctc
      241 gaaagcggt  tcgacgtgaa cacgtccgcc ctcggcacg ttcggcacg gcagccgat gttcggccgg
      301 caggcgttcg  tcggactcgg gactactatct cgacgtcctg ttccggcacg gcaactgggg ccgccagtac
      361 gattcggcatc  cgttcgaaca cgacacgcgcc ctgcgggct cgcggcaccg gcaaactgggg cggacgtcgg
      421 ttctcgatc cgtcgacaca cgacacaccc cgacacgact tccgtgaa caacggggctt cagcagcaag
      481 agtacgcga gccggactg  gaacggctg  tcggctcggcg gcacgtacgag cttcagcaac
      541 agcaccggct  tctcgacaca ccgtccagcc agcctcggcg cgcgtattc gctcgcgcgc
      601 ctgcaggtcg cgccgccgta ccctccgcgta ctccgcccgg gggtttcgg cgggccgtcg
      661 atcgccgcgg acgcagcgaa  acgacccga ttcgtctaca cgagaaccga cttgagaaaca
      721 aactacacgt  tcgggccccgc gacggtccgc acggtccgg  cgtccgggct cgccgcgacg
      781 ccggtctgca  cgctctactc gccggcgtcg acgccgtcga ctcgccgcgt ctacgtcggc
      841 aaaaattcgaca  acttgcaggt caacggcaag tatcagctga caagccgaag
      901 ggccgagtga tgtatacgg  cggcaggtc  gatgccgcga ggcaggcc caagccgaag
      961 taccacagg  tcggggctgat ggccgactac agcctgcga agcctaccctg
     1021 cagggcgcgt ggcaaaggt  ggccaggcc  cgaaccgcga cgggccca caagccgcgac
     1081 gtgtgcggga  ccgacgggcc  gtcgtcgcg  tcgaaccagt tcgcgcgcgt cgcgccgatt
     1141 cgtcacaagt tctga 1 mrkhvifaaa   laafaapafa  qdsvtlygvi  degfnytnnv  svngagkady  qlasgyaggs
      61 rwglkgsedl   ggglkaiftl  esgfdvnngr  lgggsrmfgr  qafvglgtsr  fgtlfgrqy     199
     121 dsvvdylapl   tangnwgtl   fshpfdndnt  dnsfrvnntv  kyaspdwngl  svgtysfsn
     181 stgfsmnrqy   slgaqyslag  lqvaaaylqa  nhpgaggaga  iaaddanfva  erlrvfgggl
     241 nyftgpatvg   fvytktdlkn  pvstvylpas  tfaglglgat  kfdnfevngk  yqltsafyvg
     301 aqyvytdgkf   daatgsikpk  yhtvglmady  slskrtdvyl  qgawqkvagd  rtgaaddggy
     361 vvgtdgpsss   sngfavraai  rhkf 814 39 161520486 YP_001583913  223
        1 atgaacaaga   ctctgatcgt  tgcagcagct  cgcagcatcgt  gcagcagcgct cgctcacgcg
       61 caaggcagcg   tcacgctgta  cggcagtgca  gcagcaggca  gacgcaggca  aagcaacgtt
      121 cagccggcccc  cggccaggct  tggcaagtcg  ctgtggtcga  ctggtcggg  cattgaccag
      181 agcccgcttcg   acactggcag  cggcgaagac  ttcggaaagc  gcctgaaggc  gatcttcacg
      241 ttggagagcg   gcttcgacat  cggcaacgg  cgttccgta  acaacggcgg  catgttcaac
      301 cgtcaggcgtt  tgtcggtct   aagactact   tgctccgtg   taccaccgg   caagctgggg
      361 gactccgtc    aagactacct  ggctccgtg   ggcccaacgg  accgcaacgg  tggtacgtac
      421 ttccgcgg     cgacaactg   cgacaactg   agcaacctg   gtgccacctg  gccgaacaca
      481 agcatcaagt   tcacgagccg  gccctgcaat  ggcctacagc  gcttcagcg   gtactgcgtc
      541 tcgaacaaca   cgaacttccg  gcttacagcc  tgcgtactcg  gcttcagccg  gtaccagttc
      601 caaggccttg   agatccgcag  accgcaccgg  ccaagctgaa  accgggcca   aagaccggc
      661 gggccagttg   acacgccttg   aacgcaaggc  cgcaggcagc  cgtacggcg   agctgtggg
      721 tacgcattcg   gccccggcaca  agtcgggccca  gcatgacgcg  aactaccgaa  ggaacaacag
      781 ggcggaccg    gtacgtcggt  cgcatcggt   cgtgcttac   agtactcgaa  catgcgtat
      841 acgcctgttc   aagactacct  ggctccgtgg  gcctgcttac  agtactcgaa  tggcagaac
      901 acgcctcact   ggcacccagt  ggccactgga  tccacagctt  actactcgaa  gggccaggac
      961 gtgtacgcac   aggctgcgca  ggctgtgga   cgcgtcggat  agcgcgcgat  ctacaacggc
     1021 aacatcgaca   cgtgcccgag  ctcgtgatc   accaaaccg   agccaaaccg  tggtctgcgt
     1081 caccgttctct  aa
```

-continued

```
815    55    161521143 YP_001584570

200      1  mnktlivaaa aasfatvaha qssvtlygvl dagityqsnv qpapgqagks lwsmgsgidq
        61  srfglrgsed lggglkaift lesgfdigng rfrnggmfn rqafvglssq ygtvtlgkqy
       121  dsvqdylapl tatgswggty fahvgnfdnl stngyspnn sikftsanya glqfggtysf
       181  smntnfgnnr aysggvsyqf qglkiagays qlnmpgqttg gavdtlqtgg rvrtygaaag
       241  yafgpaqvga avtqarldnt gatgtsvrid nyevngkynl tpaiglgvay tysnarlgqd
       301  sahwhqvglq adyvalsktd vyqaqavyqra sganasiyng nidtipsssi nqtaatvglr
       361  hrf
```

```
816    58    161524787 YP_001579799

224      1  atgaagaaac ttgctctctc ggccctctcg ctcgccctgc tggcgcctgc cggcgctgca
        61  cagctcaat ccagcgtgac gctgtacgac gtgatcgata cgtcgattgc ctatgttcat
       121  ggcaatgacg gccaagccaa caacatgtgg caaatgctgt cgggcaacct gcaaggcagc
       181  cgctggggcc tgaaggggtg tatcgaggctg gcgagaactg tgaagcaat cttccagagc
       241  gaaaacggct tcaaccggg cacgggcaag ctgagcgcag caaacacgat cttcaacgc
       301  caggcattcg tcggtctgca agccaccag tacgctacgc tgacgctcgg ccgccagtac
       361  gacccggtcg tcgaccttgt ccagcagtgt acggctgaca actactccg cagttcttc
       421  gcgaccccgg gtgacgtcga gtgaccgaa caacacgcag caacaagctgc gcgatccaag
       481  tacacgtcgc cgtcctacgc cggcttccag ttcgaaggca tgtacggcct gagcgcatc
       541  gcaggcaagc cggccaggg tcagacgtgg tcggtgtcg aacaacccgt caacgcggtc
       601  atcggcatcg cagccggcta cttctacgg gacgtcgac aacatctcga acgccccgac
       661  cgtcgcggct gggctcgac gacgtcgcag cgcatcgcag caagtccgca gatcgaccg
       721  tatgtgacgg cgagtcgat gctcggcta cagcaacgg caatcaaagc ctcgacttcg
       781  gtgacgttcg gctcgaccg agagtacaa cacgggccg aaggccttc gtaccaggt cggacgcgcg
       841  tcgtcgaccg gctctgcta cacgggccg ctcgtacacg cgaaggga gcaacacgga cgcgaagtac
       901  ctgctgctga cccaggttt cgctcgggc agactactcg ctgtcgaagc ggacgacgt ctacctggtc
       961  caccagttt cgctgggcgc aacacgcag gcgcacagg gcgcagcaag gtgcgcagcg
      1021  gggcgtacc caacgcaag cggatcgtcg tgcctatgcc ggcaggagat ggtgccctc
      1081  caagcgtcga agccgtcga acaagttcta a
      1141  ggcctgcgcc
```

```
201      1  mkklalsals lallgaagaa qaqssvtlyg vidtsiayvh gndqqanmmw qmlsgnlqgs
        61  rwglkgaedl gggkaifqi engfnpgtgk qafvglqsnq ygtitlgqy
       121  dpvvdlvqav tadnyfgsff atpgdvdhnd nslrvsnaik ytspyyagfq feqmyglsgi
       181  agkpqggtw saaaaynmgp igiaaagyfya mnpsptttav nspqwgstsd nivdgpinag
       241  yvtaksigia qvaaqyaigp vtfglysna qykpdaystf sstekyntgr gfvtyqvtap
       301  lllgkgysyt kasgntdaky hqvslgadys lskrtdvylv gayqhasgtq lntdgttsaa
       361  qasigsygya gtksqemvral glrhkf
```

```
225      1  tcacgcgtcg tcggcgtcg tgccgcgcgt ccgagcgcgc gatacagcgc
        61  gatcgcgttc gctcgcgcca gctcgagaca cggatcagc cgtgtccgcg atcgtacgt
       121  gctgcgctgc gtcgcgagca gtcgagcgaa cgtcgcagcg cggtcacgcg aacgacgtc
       181  ccgagcttc agccgagcca cgcggcttcg gtcgcacgat cgtcagcgcg ccagctggcg
       241  ctcgatcag tcggtgccg tcaaggcgtt caatgccacc cgtcgcgacc cggaacctcg gcctcacggt
       301  cttcccatac ctcgcgaccg cggcaaaa caatcgcc cggcagcgc gcgacgtcga gatccggcg
       361  attggcgccc atcggcggc cgatgccgag aaaaacgcg gcgcaaatcg cgtaatcgc gagacctcgt
       421  ccggccgggg aaaagcccgg cgccgaccgg gcgcgtccgg gcgtccgcgg ccttgagccg
       481  gatgcgggcc tgccggatgt ccggcgcaga ctcgagcaga cgtcgccag caccgggccg
       541  cgatccggcc gaccgcgcg atctcaggcc gcgcgacgc cgtatcgtcg tgctcgcgaa cgcagctggcg
       601  gaccgcgcg ccgagctc agcgcagca gcgcgacgcc gcggccgaca cgcagtcg cgcagcgcgaa
       661  atcgcggca gcgcagtgca gcgcggcgct gcggccgaga cgcgcgcag gaccagcga tcgcatcgct
       721  gtgcgatgca cgccggcaa gcaaggcggc cgccagcgaa gttcgtcga gttcgtcag catcgagcgt
       781  cgtgccggcc gcatcgcgcc gcataagcgg caaaacgcgg cgggtcagg ccttgagccg
       841  gcgtcggcg aacaggcgg gcgcgcggt gttcgtcag cgccagcgg catccgagcg
       901  ttcggcgatc acccgcgcgc ttcggcgatc agccggcgc atcggcgcg ctgcgcgcaa aatactcggc
```

-continued

```
 961 cagcgctgca tcggacagat tgcgcacgt cccgaacaga tcgagttcgt atcgctgat
1021 gccgacgccc gcccgataca gccgcttcac cgcgtcctcg cgcaggaccg gacgtattg
1081 ccgcgtgcgt tcgtaaccgg tgctgcagca tttcgcacgg gccacgcgc atccgctccg caccgtgcac
1141 gcgtacatc gcggcgcct cgtcgagcg gccagcccg atccgcagat cgcgattgtt
1201 gggagcgcc gcgtcgatcc atgcgccgc cgcgggcgcg gaaagccgac ggccgtcgt gctgccagtc
1261 gtcgagcagc gacccgttc gtataccggg cgcgcaccgg cgcagccgga cgtcgtagc gcggccgtc
1321 gaccgttc gtataccggg gccagcacga gtcgcacga gcgcagccgg cctgtagc gcggccgag
1381 cgaacagccg cgcccgatca gcgcgcaaac cagccgaac cagccgcaaac gcgcgcgcg
1441 gcgcgaatcg gaacgatgcc tcat 1 mrhsdsrrt arrapfalaa alvlagcsla pryerpaapv psayngvda thdapsafap
  61 radaalldw rsyftapalh awidaalamn rdlriaagrl dearamygvq raermpsida
 121 stgyertrgy dpvlresavs glyragvgis ayeldlfgrv rnlsdaalae yfatadaqrt
 181 vrigviaeva nayvaerain eqralerti darerialt qrryaagtsd aielrsaeml
 241 vaaarashaa lqrehaqavr alqllagdfa rvrddtal daltiapvap gapsdller
 301 pdirqaesrl kaahaqigaa raaffprial ttdygsysda fssifaagts vwtfapritl
 361 pifaggrnra nldvanarrh iavaeyektv qvafrevada ftardwierq laaqrdvhaa
 421 ddarlklaer ryaggvatyl elldaqrsty esggelirlr qlrlanaial yralgggwtp
 481 gtaadda 1 atgatgcaaa aacacgcttt gactgcaatc gcggtcgcgc tccttgccgc aggctgcacg
  61 ttgccgcgcg actacacgcg cccgacgcg cgctgccggg ccggcaccgg gcgcagccgg gtccggcgc
 121 gtctatgcga ccgcatcgga cgcgcgggg cttcgtcgat cgcgtacgcg cgaacggca cgagatcgcg
 181 gccatcacg ggcgccaatt cttcgtcgat cgcgtgtgcg gccaccgcgg gctgccggg agccggg cgagatcgcg
 241 ctgaagaaca accccgacct cgccgcgggg cctgttcccg acgccgacgg gtgctgaaca gcggcgca
 301 tatcagatca cgcgcagggt cgcagggcgt ggagctcgat ggtcgccgt atatccgcg cgctacaac
 361 gcgcgtgtgc gcagccttgt cgcagtatct gtcgaccga tatgccggc aggtcgcagg cctgaaggac
 421 caggcgctg cgcagcacga gtcgcgatca gtatctgacg ctgtgtcga ccgacgatct gctgaaggtc
 481 gtgtcgcagg cgtgcagaga tggtcaggc cgagctgcgt cggcaggt tcttacgacc tgacaagct gcagtcgac
 541 acggaagaca cgtccgagct cgagctgcgt ggcgcaggg cggcaggg cgcgcaga cgtcgtcga gcaggcgtc
 601 aacggcaccg gtcccgagct cgagctgcgt ggcgcaggg gccgcaggg cgccgcaga gggctgcga gcaggcgtc
 661 gcgaaccagc agggcaggg atcgcgcgt gccgcgg agccgcaggg ttaacgcgt ggtgcgctg
 721 atcggcgagc cgctgcgcga cgatctgcga gtcgcgtcga gatctgctga cgcccgtcc cgagatcatg
 781 ctcccgacg tgccggccgg agacgctgct gcgcaggct gatctgctga gcaacatcg gccgccattc cggcgcgcg
 841 cagccgagc agacgtgct ggtcgaccg ggccgcgtt ggtcgcaacg gccaccgga tcacgatgcg gatcttcgaa
 901 ttcccgcgca tctcgctgac gcggcgcggc gcccgcgtcg ccgcggc gcaacacccga gccgcgggcg tcgctctgt
 961 tcaaggccg gcaccggc gctggtgtc gccaacctc gccgcagcag gccaccgagc gcaccgcag gcccgcggcg gatcttcgaa
1021 ggggcaga acatcgcaa aggcgatcca gagcgcggttc cgtcgcctc cggccaagg cgcgcaggt ggccggctg
1081 aactacgaga ggcgatcca gaccggttc cgtcgcctc cggccaagg cgcgcaggt ggccggctg
1141 ggcacacggcg atccgcagat gcgcggc cagtcgacc gcccacgca gcatcgcca gcacggc cagccgcgc
1201 ttcgatctgt cgagctggt ctacaagac cagcggc ggcgcaagg gctactctgt cgtcgtacc
1261 gcagagaccg atctgtacc gcgcagcag ggccaaggc cgcaggcaga acgcggct gcagaagtcg
1321 acgaacctcg tcgatcgta cggtgctgct gggccgc gcgccgcgt tggatcgagcg ggcggcgcg
1381 acgccgatca tcgcggcgt cgcgccctc cgcatcgca gcatgccaa ggccgcgcg ggcgggcgc
1441 tcgctgcgg cgcgacgg gtaa 1 mmqkhaltai avallaagct laphytrpda lknnrdlrvs vinieaaraq arsangqaat
  61 aigwreffvd prlqrliela lknnrdlrvs vinieaaraq yqitraglfp tldqtgtgni
 121 qrvpggvsqt gapyisrvyn vglsasweld lfgrvqslkd qalaqyista yarqaeisl
 181 vsqvadqylt lletddllkv tedtlktaqa sydltklqfd ngtgselelr qadtvvegal
 241 anqqaqarar aqalnalvli igeplpddlp pglpldaqnl ladvpaglps dllrrpdim
 301 qaeqtllaan anigaaaraaf fprislgaf gtaspllggl fkagtaawsf apqitmpife
```

817 55 161523870 YP_001578882

202

226

203

-continued

| | | | | | | |
|---|---|---|---|---|---|---|
| 361 | ggmianlnl | anvqkrieia | nyekaiqsaf | revadqlaar | gtydqqiaal | ernthaqrr |
| 421 | fdlsdlrykn | gvdsylsvlt | aqtdlytaqq | alinarlarw | tnlvdlyral | gggwierage |
| 481 | tprapdqtvd | ydkasapasa | saaatng | | | |

818 19 161524257 YP_001579269

| | | | | | | |
|---|---|---|---|---|---|---|
| 1 | ttactccggc | gaaccatca | tcgactgctg | atagtctgc | aggcgacct | tgccgatcag |
| 61 | gtcgatctgc | gtttccagcc | gacacgagt | ctcttccgga | tcgtcggaga | tctttcgaa |
| 121 | gattccgcgc | gacacgtagt | ccgcaccga | ttcgcaatag | ggatcgctt | ccttgcaggt |
| 181 | ggccgcgag | atccgctga | gttcaggtc | gcacttcagg | gcatttcgg | tctcctcgc |
| 241 | gacagcagc | tgtgcagat | ctgcaggtt | cggcaggccg | tcgagcatga | acacgcgttc |
| 301 | gatccgagc | tccgcggtgt | tcattcgcc | tgtatccgg | gatcgactcg | gttgccgag |
| 361 | cttgtcgag | cccagtgct | tgtacatgg | ggcatgcagg | aagtactggt | tgatcgcgt |
| 421 | gagtccgttc | ttcaggtgg | cgtcaggta | tccgatgact | ttccttgtgcg | cttgcat |

819 8.5 161524255 YP_001579267

| | | | | | | |
|---|---|---|---|---|---|---|
| 1 | mqggdkkviey | lnaqlknelt | ainqyflhar | mykhwgldkl | gkheydesig | emkhadwlie |
| 61 | rvfmldglpn | lqdlhklvg | eeteeilkcd | lkleqisqat | ckealayces | vrdyvsreif |
| 121 | ekilddteeh | idwletqidl | igkvlgnyq | qsmmgspe | | |

228 161524255 YP_001579267

| | | | | | | |
|---|---|---|---|---|---|---|
| 1 | tcaggccgc | ttgcgttcgt | agaacgtcac | cggaatcgga | tgagcgtgat | gctcgacgcc |
| 61 | gcaccggctc | cgcacacgc | cgtgttcggc | catcggtcg | cgtaccgact | cctgcatt |
| 121 | gccgcagcga | gtcgccacg | caagctcgaa | ctgaagctcg | tcgaacgctc | ccacgccctc |
| 181 | cgcgggac | gcggaatct | tccgatcga | aacagacttg | catacgcaga | cgatcat |

205 161520970 YP_001584397

| | | | | | | |
|---|---|---|---|---|---|---|
| 1 | mivcvcksvs | drkiraslae | gvdsfdelqf | elgvatccgk | ceesvrdlma | ehgvcasrcg |
| 61 | vehhahpipv | tfyerkaa | | | | |

229 161520970 YP_001584397

| | | | | | | |
|---|---|---|---|---|---|---|
| 1 | tcacttgaac | cggatgtcg | gattgatgac | cgcgtagagc | acgtcgacgg | tcaggttgat |
| 61 | caggatgaat | tcgacgaga | acagcagcac | gatcgcctgg | atcaccgggt | aacgcgcat |
| 121 | cgtcaccgaa | tcgacgagca | ccggcagga | cccccgactg | ttgaacacga | ccttgacgtt |
| 181 | gatcgaccg | ctgcagtgtt | agccgaactg | cagcccatc | atcgtgacga | ccgaatcat |
| 241 | cgcgttgcgc | aagcagtgtt | tgagcacgac | cttccgtcg | tgcacaccct | tcgccgcgc |
| 301 | ggtgcgcacg | aagtccctcg | tcatccactc | gacgaacgac | gcgcgagca | agtagcctc |
| 361 | cacggcgacg | acccggccgc | cgagcgtgaa | cgaggagcag | catccgagga | atcccatca |
| 421 | gtccgacacg | acggagcca | agcgagctt | caccggaaag | ccggagaag | agacatgcc |
| 481 | gagccgaac | gccgaaacg | agatgccgga | cgagccgag | gtcatgccga | gccgtccgg |
| 541 | ccagcggttg | cgccatacgg | ccgatacgt | gccgatcgcc | gcgatgccgc | gcccgcca |
| 601 | cgcatgctg | acgatcgtca | gcatcagcgt | cgagccgaag | cgctcgccga | tttccgtcga |
| 661 | taccgccgcg | ctgtcgccg | tcgatacccg | gaaatccccg | tgtgcagtct | tcacgaagaa |
| 721 | atccgaac | tgctggca | gcgcccgatc | gaggccgaga | gaggccgcca | tcggcaataa |
| 781 | cgtccgttcg | tcggccgcg | aagctcgcg | gcccgcc | gagctgcccg | agcgccat |
| 841 | cacgaacaga | aacacgagca | cggccgacgat | cgcgagcgtg | cgcgagcagc | cgaacagccg |
| 901 | tttgatgatg | aaagtcagca | t | | | |

206

| | | | | | | |
|---|---|---|---|---|---|---|
| 1 | mltfiikrlf | glptlaiva | vlvflfvhll | pgdparlaag | peadeatval | vradlgldrp |
| 61 | lptqfanffv | kiahgdfgvs | trskrpvste | igerfmptlm | ltivsmawat | lfgmaigias |
| 121 | awrnrwpdr | lgmtlavsgi | sfpafalgml | lmeifsvklg | wlpvvpddtw | ksyvlpsltl |
| 181 | gaavaavmar | ftrasfvevm | nedfvrtara | kgvheepkvvl | khclrnamip | vvtmmglqfg |
| 241 | flggsivve | avfnwplgr | llydsvtmrd | ypviqaivll | fslefilinl | tvdvlyavin |
| 301 | ptirfk | | | | | |

230 161520872 YP_001584299

| | | | | | | |
|---|---|---|---|---|---|---|
| 1 | tcagaagcgg | tggatcatgc | cgacgccgac | ggcgatctgg | ttctggccgc | cacctgctgc |
| 61 | cagccgtcg | ccgattgcg | tcgttgccga | ctcgagtgcc | ccagcttgc | gtgcctgtatt |
| 121 | gccgctcgcg | cgtggtacg | ctcgagtacg | gtacaggccc | gtcaggcttcg | acaggctgta |
| 181 | gtactgcgac | agcgtgacct | gtggtactt | cgccgagctc | gagatgccgt | tcgacttcgt |

-continued

```
 241 tgccgccgtg tacgagtagc cgccgagcga gtcccactga gccctgcct tcagtgcag
 301 cacgccaccg cgtcgtgttga agatcgcggt gttcggaaac gacgagccga cgccgggat
 361 gtactggaccg ttcgtgtagg cagcggacac ggcgtgaact ccgtgaact ggtagccgc
 421 cgtcgcccg aggcgctgt gcgattgcc cgtgtcgtag ccgtgttga cgcgacac
 481 ggccggctgg cgccgtcg tgaccgtcga gatgctgcc cacgcgccc cgcgagcgt
 541 cgagttgttg acgcgctgat agccgaccgc ggccgttca ggtactgat
 601 cgccgcggctc cacgcgagc gtgaaggcct gggttcaac acgccgcca acagtacga
 661 gccgccgacc gtgaagccgt agaacttcgg cgacatgtag acgacgaat tgttcgcgg
 721 gtagctcgta tcgacgagt cgatatcacc cgggtgcgcg ccgtatgcc cgtcagcca
 781 cgtcgtcggg ctgtacgcg acagcagcgt gtagtacggc gtgtactggc gaccagcgt
 841 cagcgtaccg tacgccggt tcgtcaggc gacccaccg tgacgtga agatgccgc
 901 cgaccactgc gatccgcccg ttgccgtgtt cacgccgtt tcgacctgga agatcgctt
 961 cgtcgccgcg ccggagtctt cgttgcctt caggccgaag cggctgcctg cccacacgcc
1021 ggttgacatc gacacccttg aatgaccgcc gctcgtcgcg ccgtcgacg gtcccgcgtt
1081 atttggtac gccagaccgt tatcgacgat accgtacagg gtcacgctgc tctgagcgtg
1141 gccggcgta ggccggcaa cgtcatgcc cgtcatggcg acgacgcg gctttcat 1 mkkrvvvamt aaglaaataa hagsvtlyg ivdnglaygn naaptgats gghskvsmst
  61 gvwagsrfgl kgnedlggt wltgaygahp ntatqasqws ggiftrqawv gltnaaygtl
 121 tagrqytayy tllspyspt wltgayahp gdidsldtsy rannslvyms pkfygftvgg
 181 sysfggvpgs vnrgstwsaa iqylngpagi avgyqrvnns tlgggawgdn stvtsggqpa
 241 vsainngyat aqsqrigvt agyqftpawd vsvsytnvqy ipgrygssfrn taifntagav
 301 lhwtaaaqwd faagysytaa tksngisssa kyhqvtlsqy yslskrtgly aleayqhasg
 361 ntlskagaiq sattqigdqv aagagqnqia vgvgmihrf 1 atgaaatcct ccccgttgtc cgtcgtgtgc gggtgcgtgcc gcaaccgcgt tgccgttcg
  61 gtccgccac tgccactggc gggctgcgg aactacatcg gcatcaagag cgacaagcag
 121 atcgccccg cgtcgcagtt cggaaaccgtc cagagccttc cagccaggg cggccactgg
 181 cgctcgctcg actgccggtt ccagttcgtg gatcgcccag cgcccaagt gatccgcgag
 241 cgctcgccg gcaatccgtc gcatcgcgcg gatcgcgcag cgcgaagct ggcgtcgtcg
 301 tatcgaat cgtcgcgtc gaacctgctg ccgaaggcct aagcagcta ctcgtggacg
 361 cgcgagtct attcggacca cggccttc ggccgcggt gagctgcaa gtggtacagc
 421 gagacacag tgccgccaa cgcctcgct cgctccgtgt cagctgcaa gaaccgcga
 481 cgctgcgca cgctgcggt gcaggaaaag gccgcggacc tacaactgc gtcaggtgg
 541 atcacgctcg cctgcggt cgcgcgcac cggcgcgag cgtcgcagt cgccagat caccgacgc
 601 cgacatcg gatcgccgga gatcgcccaa cggagtcgg cgaagagct cgccgaaagt cacccactgg
 661 cgccggtcg ccggcctca cacgaccgtc gaacgccaa cgcaatgcc gcccactcgc caatcgcg
 721 acgaccagg cgtcgctgtc cgatctgcac gcccaaggt cagtcgata tgccgcggc taccagctc
 781 gccactgc tcggcaaggg acccaaggg acccgaccag tgccccgcc tcgcctgaac ggtcctgaac
 841 ccggcccgcg agtcgcggct acccgacaac ctgcccgcg cagcgcttc acctcgtatc gcgccgccc
 901 gacatcgcg ccgcgctca actacaacca agcgcaatcg agcgcctgaa agacgtgaa ggaagcgaag
 961 gccgagttct ccccgacgt gaacctgttcg gccggttcg gtttcgatgc gttcgctgg
1021 ggcaaattcc tgaacttcac gagccgcag gcgcgccag gcgcagttcg ccggcggat cctcgccg
1081 atcttcgacg ccggccgct cgcgccgcgt gcgcgtcgt gagctcggcc ctcaaggcc cttcgatctg
1141 tcggtcgcga actacaacca gacagcaca gacgctgatc agcgcctgaa aggcgcctcc gaccaagtt
1201 gccggatcc gtgcagtcga tcgccagata tgccagatgc ggtgattcgc gcgacgcg agcgcgtcg
1261 acgcgcgcat acgatccgc ggtcaaggcc gccgtcgcc cctgacgcg gcagctgcg
1321 gtgctgaccg acagcagcaa cggcgatc tcggcagca aggcgcctgaa agggcgcgcg tcgaagtg
1381 cgccggcgcga acatgccggg acgaccacgc aaggcgcctt aagcggcctt cgatcgaacc
1441 ggcaccgcgc tcgcggccgc cgagaccccc aaacagaccc gacaggccgc caactga
```

207

822   56  161524923  YP_001579935

231

```
208       1 mksplsvra grrtavava vaalalagca nyigiksdkq iapasqfeta qslpaqgghw
         61 pslqwasqfg dpqlpklide alagnpsiaq aqariakass yiessrsnll pkaeasyswt
        121 relysanglf pppyggwys ennvlaasw eldlwqknre rlrtavsqek aaeadmqqar
        181 itlassvart ynslaqlyal rdiaqreian resvgkitdg rvsagldtnv erqtargnia
        241 ttqaslsdld gqittvryql aallgtkgpdr glqiaapvln pagdvalpdn lpadlvsrrp
        301 divaarwqve aamhdvkeak aeffpdvnla afgfdafgw gkfinftsrq aqfgpaihlp
        361 ifdagalraq lkgryadfdl svanynqtli salndvatqv aairaidrqm gdaqraldas
        421 traytlavir ykaglspqlq vltadsmrla seqtvtnlkm rrrdmqlali kalgggfdat
        481 gtalaapeta kqtrqaan 232       1 tcacgcgac cattcagtt ctccatgaa agtgcgaccc ggatacgggt ggaacacgta
         61 gtagggcgg tcctcagtc tgtcagtgac aaccgatgcg gtcagtgac gatcgaacg
        121 atagcgcc ttcacgtcga cgaccgtaaa cgcctcgtg cgccataga cgacgtcgc
        181 cacgtcgctg tgtcgagcg tgttgaactg ccggcccgaa tagccacgc cgacgctcgc
        241 gagcagtgc tcgtcagagc gatacgacgc gagagattc gcggcatcc gcgaatgcg
        301 cggaaagtgc gagccggt acgccgggt gggcgccat gcgagatct gctcattgct
        361 cgccgatacg ttccgtcga tccgtcagcc cttgagccg gacgtcgag acgtttcgc cgctgaacgc
        421 gagtcgacg ccgcgcacg gcacgtcgtc gtagatgga tgtcctgga cctcgagggc
        481 gccggtcagc gtcgctggc ccgcgctc cgtcgtgaag tcccagtcga acacgctcgc
        541 acgcacgcga ccgcgccga ttcggcgat cgcgtcgtt gagatcgtcc cctgaacag
        601 gggcgcagg ttccgatgt cgtgacgt cgtgtcgt cgcgaacgc gcaacacgtc
        661 cttcccgacc gtcgaaaac gcgtgccgt cgaacgac agcggaagc gatccgcata
        721 ggtcgcatcc cattgcagcg caacttccg cgaccgcg ttgccgctgc agaccggctg
        781 cgcgaacgtg cgctcgagc gtccgtgac acgtgtcgt gtgtccccat cccaatgcgc
        841 cagccgcagc gtccgcgagc acgccgggc gaagcgcat ggcgagcgac gtccctcgcg cgtagagcgc
        901 ctgcgtcgc gatcgcgcg gatacgcgt cggtgccag gataagttg tcgagtgat agccgaacgt
        961 gtcgcgtg ttgtatgtga cgttatgtga cgttcagg gcctttcagg tcgacgtgc gcagccgt
       1021 gaacgcatga cgtcaccct tgcccgccc gcccgcgg gtaacgcgg cgcagccgac
       1081 gcgcaccc tggaacag gccgcgccc tgcccgccc gcccgcgg gtaacgcgg acggagccg
       1141 gtccgcgac agtcgtacg ccgacacgag ccgacacgt cccgacgac gcgacagc acggagccg
       1201 gccgttcagc ccgaacgct acagccagtt ctccggtcg gcccgccat ttgccgccat agaccggctg
       1261 gccgggcgcg atcgtcagt tctgccgcg cgtccgccac gatcgccacg ttgccgccac cgtttcgtt
       1321 gccgaacgcg ccgcaagaa acgtgtcgt gtgtccccat cccaatgcgc gctgtcgcg gcttgtacgt
       1381 gagccgcagc gtccgtcga cgccgtcggt cgccgcatag gaaccgcata gccctgcca cgtttcgtt
       1441 gatccgctcg gtccgtcga gcgatcgca gccgacgat gtgccgcct gtgccttcgg cgttgtacgt
       1501 ccgatgcg ctcggtcgg ccggcacggg cacccggg acctgttcg aggtcgggc cgttgtagct
       1561 ccgtcgcg ctccgtccg gcatccggt accgtcgtc tcgagccggc cgagccggc gcagccgac
       1621 cgagaaccag aagcggcga tcggttcgc gtccggtcga gtctgatgat tgccgccgaa tgccgccgaa
       1681 gctgtccggg aatccgtagc cgtccgata cgtccggt agagacactg tcgacagca tcgacagca
       1741 cgcctcgagc ttgcccggcc cgtccgccc gccgccgtgg cgtcgagcg gtcgagccga tcgattgcc
       1801 cggataacag ccgcaaacg gccgcatacg gccgcacgg cgcgcatgt cgtcgggcc
       1861 gatcagcgac cagacggcg gtaccgggat gataccgat acgtcgaaacg agcaggttcg acaacacag
       1921 gccgtccgca tagacgaggc ccgcgccga tatagcgctt ttgaagtcg gccccgccgaa cgtactcag
       1981 cagctcgttg ccgcctcggc gcgcctcggt ctgtatcgcc agctgcggc gcggttcgg cgtcttcag
       2041 cgtcctcagg ccgctcgagt tgttccaagt cgtatgatt gcgcaacagc tcgcgtcgg tcgattcgac
       2101 gacgcggcc gcgcaaaacg gccgcatacg gccggctgc gcgctgggc gcgcacggg cggcctcgga
       2161 cgtgtcgcgg gataccgga ccgcgccgcgt gataccgat cgaccggcc gaacgccggg acaacagcag
       2221 cggaaatgcg cgtcggcgg cggtcgcgg gatcgcggac cggtcgtc cgaaccggt cgacgaccag
       2281 cgcatatgcg cagcgaagg caaaagcgg gatcgcggac cggtcgtc agccgcgtg cggacgatgc
       2341 cgtcgcgcg cagggtaa gcaacat 823  85 161525558 YP_001580570
```

-continued

```
  209
    1 mltlaarpt rgrlalacaa afalpgayaa ssdsaptdpv rdpanrsara vppaasaasa
   61 asepagdtl savsvtaqrq pldpdtpavv esmtreridt htnvtaedtl kyapnlmvrk
  121 ryiqdrnsvf agrdfnelqs arglvyadgi llsnligssy aypprwslia pddiarvdvl
  181 ygpfsaalypg naigstvlit trrpdkleas lstqfftqry rdgyfadsf ggnhqtaria
  241 nrigrfwfsl sldrlendgq pmqyaspnas ynaklgravp vtgaatdigp ngkartivga
  301 qslerteqin etvrmgyaft drvdatitlg hwenhyrqhg dtfirdaagq pvyggnvaig
  361 gqnitiapga fapqrgdqen wlyafglngr lasgwrlsgi vsaydvsrdv lraastaggg
  421 agtiqggdt gwrtldlkae apevhghaft fgyhydnyfl rnvtyntadw lngpvtslas
  481 vyrgdtrtqa lyaqdawrfa pgwlatiglr yerwdaygga lgnasgtfgy adrsanalsp
  541 kvalqwdatd vwfrlsfat gtrfptvgel fqgtisnnai vmnmpnlrpe kaidwdftae
  601 rdvygvvra svfqsdlrds iysqttvaga stvtnisnvd rvrrgvela fsgenvglkg
  661 laidanvsas naqiladaan payvgsrfpr iprmranlla syrfdehwla svgvrysgrq
  721 fntldnsdvn pdvyggtsaf tvvdvkaryr fdrhwtasvg idnltdrryy vfhpypgrtf
  781 ygelkwsl 233
  824 78 161520731 YP_001584158
    1 tcagaacgtc gtcgccatcac cggcgcaatc gctgcgccg ccttgcgccg cgaagcgccg
   61 cacgacgag gtcgtcgtag cgatgtcctg gatcgtcagg ttgtcgccga gcagatacgc
  121 gagccagtgc gtcgccgca cgcggaactt gtacgtcagc gtacgtcagc accacgcga gcaggtata
  181 gccggccggtc ggttcatcgt gccgatcgc gcgatgtgc gacccacgcgt gcgatgcgt gctgagctg
  241 cgcgccgtc ccgaacggac acgcgctccg cgtagccga atcgccgcgt agcgtcgac cgagcggtgc
  301 gatgcggc agccgtcgc acgcgtcgac gttgcgcgca atcgacgcga tgctatagt cgagccgtca
  361 ctcgaggtcg acgtgtgc gccgcgcca cgtcgtgtgc gatacgcga gacggcctcg gcgagcgcgt cgtcggtgcc
  421 gcctagaac tccgcgca tccgcgcca cgtcgtcag gatgccctcg gtccgtatt cggccagata
  481 gcgggaac ccgtcgccg cggtgtaga acatgccga gctgccgca ttcgcccga tcgatagcg
  541 gttcgaaaag cggtgtaga acatgccga cggcctttc cttcgacgca ttcgattgc tcgatcagta
  601 cagcgacaga tcggtcgaca cggcctttc cttcgacgca ttcgattgc tcgatcagta
  661 ctgcccgtc gcatcgtcg ggccgttcga atagagctcg tagaacgtgg gccgcgttc
  721 ggtgtacgc acgttcggg cctcgcggc cgggttcgtc gatgagcggc gcgaaaaaca gccgccggc
  781 cgacacgctg cctgcgttga acgtcgcga ttgcgcccc gcgaattct tcagcgccgg tcagccgggt
  841 cgatcggga tcgacgtca catgtcgat gctcgtcgcc ctcgagttga aggtccagct tgtgtcgcg tcaacgccgg
  901 atcgacctgc cattcctcga ggcgagaacgt cgcacgccg cggtgcgcg aactgcacg cgatcgcgcc
  961 cagcgttcg tcgccgagcg ccaagctcg ggtgccgcg ctgcgatgcg gctctgtagc gccgattgcg
 1021 ttcgagcgc gcctgcgttg gcgatcga ttcctgtgg cagcttgtgc gcctcgacg cgaggcgag
 1081 gaactcgtc gggttcgc ccgttcgac ttcctgtgg cgctgtgcgc acgcaccgt agttcgattc
 1141 gtcgaatttc agctcgagga cgatgccca acggcccgg gtcttcggcg accaccgt agttcgattc
 1201 gcgtcctga cgatgccca gccgcacgtg gccgcacgtg gtcttcggcg accaccgt agttcgattc
 1261 gtagccgctg tacgaccga ccgcgaaac gtcgcgccca cacgcgaag atcgcccag cgccgaccgc
 1321 gccgccgtc acgcgccgt cgtgttcgg cgctgttccg cacgcgtccg acggtcggg gctgtcggg
 1381 gccgtcgagc gcgcgtgcg tatccgtcg cgatcagcg gaatccgca ttgccgcct cgatccgcgt
 1441 ttcgcgatcg aatgccgtcg cgtgaacgc gctgaacgc gaagcggca cgccccgtac cgccgaccg
 1501 gggccgcgc cgctgccgt cgctcgtcga gtagccgca gtagccgcga tcgaccgac tcgccggac
 1561 gtcgatcgcc tcgcgggga tccggttcgt cccggttcgt gatcgttc acgagccgc cgatccgtt
 1621 gccgccgtac agcaacccg cgggaccgcg cacgacgca cacgacgca cacgctcg tcacagcgg
 1681 gtcttccga acggcatgt cgtacgagt cgcgaaag ctgtagcgcg ccaccgctt
 1741 ctgcagccg cggatcgcc cggatcggcat cgccgtcct cgagcgca atgggcgcg cgaccatcg
 1801 ccgtacgtc gtgtcgaca gcagccat cgcgtcgac gccgtcagc gtttcgcga gcgaatcgg
 1861 ctgccgcgc agcagccgc cgccacga ctgccgcgt cgcgagcggc ggcgcgcct gtcgggttc
 1921 cgtcagcgga ttcggcgta tcgcggtga cgcgcaagt catcgcgga cgcgcaggc ccatcagcga
 1981 cgtcgcggt gcgtcggct gcgtttgcgc cgggcaaga atgcgcaagg cgccggcc ccatcagcga
 2041 aacggcgag agcggccga agcggccga gcggagacgt ggaagcgtg gggcgcggc
 2101 catgtcgag gagtcggtg aagtcgcg gaatcgtcg ggaatcggat
 2161 gcgaatcggt ttcat
```

-continued

```
825  43  161523868  YP_001578880
```

```
210       1  mkpirgapgs  ppirfrqtst  dsstmrdlpr  lprlrplplr  plspvslmal  aalahaqtdt
         61  patatspsss  gaplapifvt  amplgdaeli  aptaqlsgda  llrqadslg   etinglpgvs
        121  tttygpmvgr  pivrgmdqdr  irllqmvaa   ydasslsydh  avpedplsie  rveivrgpaa
        181  llygnaigg   vvntidnrip  realdgptgt  ldvryggana  tragaaqveg  gngrfafhvd
        241  afdretgklr  ipgyaredtq  raldgpdtpq  pvgsvpnsdg  rvhgavgas   ytwadgfagl
        301  sysgyesnyg  svaeddvrlr  mrqerlafas  earnlpgpfs  tlkdfaytd   yrhkevdnge
        361  tattfrnrgy  earieaarhrk  lgplegaigv  qfggntfsal  gdetlvpstr  tnsvalfgle
        421  ewqvdpalkl  slggriehvn  vdpagvek    fagaqsrtfn  agsvagalf   sltpvwsiaa
        481  nvayterapt  fyelysngph  datgqylign  pnaskekavs  tdlslryasg  pnrgsvgmfy
        541  nrfenylaey  atgrivdsdg  evprgtdda   tlaadygygp  laeavyrgvr  aefygieldg  kyrvyahsgh
        601  tvdleltady  tharnvdtge  plpriaplra  tlaadygygp  fgaraqltha  wsqhrvpadd
        661  eptagytslg  vvltykfrvg  athwlaylrg  dnltnqdiry  atsvvrgfap  qggrsvmagl
        721  rttf 234       1  atgccgtcg   aacggtcc    ataccgctta  ctcactgtcg  cgaccgccgc  cgttttcctg
         61  gccgcgtgcg  ggaaaaaga   atccgccaag  ccgccgcaaa  cgccgaagt   cggcgtcgtc
        121  acgtcccagc  cgcaggccgt  accggtcttc  accgaactgc  ctggccgcac  cagcgcgttc
        181  ctcgtcgcgc  agtcccgcg   gcggtcgac   ggccggcgt   tgcgccgtga  atccaccgaa
        241  ggcagcgacg  tcaaggccgg  tcagcgcctc  tacaagatcg  accggcacc   gtatatcgcc
        301  gcgctgaaca  gcgcaaggc   gacgctcgac  aaggccgcg   cgaacctcgc  caccagaac
        361  ggcgctcgtg  cgcgctacaa  ggtgctgtg   gccgcgaacg  cggtcagca   gcaggactac
        421  gacaacgcgg  tgcccgcca   aggcaggcc   ctcggctac   gccgcgacg   tcgccgcgg  caaggcgtcg
        481  gtcgagaccg  cgcaggtcat  ccgaggccg   gccggcaac   acggacgtcg  tatcgccgat  caccgccgc
        541  gtcggcatct  ctcgggctga  gcgcgtgac   gccgggccg   cggtccaa    gtcgacctca  cgcaatccga  gacctgatg
        601  tcgaccgtgc  agcagctcga  cccggtccga  ccggtcagg   gtcgacctca  cgcaatccga  gacctgggg
        661  ctgaagctgc  gtcaggacgt  gcagaccggc  gcagagcggc  cgtcgaaga   acctattcgc  cgtgccgcg
        721  aagtgtcgc   tgatcctgga  ggacgccgc   accggcccga  tccgtcaga   tccgtcggt   gttcccgaac
        781  tccgacctga  cgtcgacca   gtccgtcgc   gtgcgcgcg   gtgccgacga  gcatcgagga  aggcgcggaac
        841  ccgggcaagg  tcctcgtgcc  atctggtgcc  gcagatcgg   gtcaacgcac  accagaaggg  ccaggcggtc
        901  gacaacgcgt  ctggtgtcc   gcaacaggtc  caacaaggtc  gagccgcga   gagccgacc   gcgcgcatc
        961  gcgatggtcg  tcaacggca   acgggtcgt   cgaaaggca   ctgcagccg   gcgatcgcgt  gatcgtgcag
       1021  gaaggtcaga  actgggtcgt  agggtcgca   gggccgccg   tgaaggccg   ttccggcca   gctcgtcg
       1081  ggtgtcgaca  agggcgcaa   acgcgtcgg   tgccccgcc   gcgcgcaca   ccgaccgg    gtcggccgc
       1141  gcgccgaacg  acgcgtcgg   tgccccgagc  tgccccgcc   ccgcccgcg   ccgaccgg    ttcggccgc
       1201  gcgcatcgg   cgccccgagc  atcgagtgcc  ggcgcgtcg   ggcgcgcgg   gcgccgcg    tagccggcc
       1261  gcggggcgt   cccggcgc    tcgggccgc   caataa 211       1  mrvervpyrl  ltvataavfl  aacgkkesap  ppqtpevgvv  tvqpqavpvf  telpgrtsaf
         61  lvaqvrarvd  givlrrefte  gsdvkaggrl  ykidpapyia  alnsakatla  kaqanlatqn
        121  alvarykvlv  aanayskqdy  dnavaagqqa  aadvaagkas  vetaqinlgy  tdvvspitgr
        181  vgisqvtpga  yvqasqatlm  stvqqldpvy  vdltqsleg   lklrgdvqsg  rlkttgpga
        241  kvsliledgr  tyspdpkqlqf  sdvtvdqttg  svtiravfpn  pgkvllpgmf  vrarieegvn
        301  dnaylvpqig  vthdqkggav  amvvnannkv  eprtlatri   egqnwvvesg  lqppdrvivq
        361  gvdkvrpgat  vkavpaqlas  apndasgaaa  paaapasaa   aasaaasasa  gasgapasaa
        421  agssaaasga  q
```

*This ID number is an internal laboratory designation that was used to identify the polypeptides in U.S. Provisional Patent Application Ser. No. 61/922,504, filed Dec. 31, 2013.

The complete disclosure of all patents, patent applications, and publications, and electronically available material (including, for instance, nucleotide sequence submissions in, e.g., GenBank and RefSeq, and amino acid sequence submissions in, e.g., SwissProt, PIR, PRF, PDB, and translations from annotated coding regions in GenBank and RefSeq) cited herein are incorporated by reference. In the event that any inconsistency exists between the disclosure of the present application and the disclosure(s) of any document incorporated herein by reference, the disclosure of the present application shall govern. The foregoing detailed description and examples have been given for clarity of understanding only. No unnecessary limitations are to be understood therefrom. The invention is not limited to the exact details shown and described, for variations obvious to one skilled in the art will be included within the invention defined by the claims.

Unless otherwise indicated, all numbers expressing quantities of components, molecular weights, and so forth used in the specification and claims are to be understood as being modified in all instances by the term "about." Accordingly, unless otherwise indicated to the contrary, the numerical parameters set forth in the specification and claims are approximations that may vary depending upon the desired properties sought to be obtained by the present invention. At the very least, and not as an attempt to limit the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. All numerical values, however, inherently contain a range necessarily resulting from the standard deviation found in their respective testing measurements.

All headings are for the convenience of the reader and should not be used to limit the meaning of the text that follows the heading, unless so specified.

SEQUENCE LISTING (234 sequences)

SEQ ID NO: 1 - protein, 738 aa, Burkholderia thailandensis
MEWATSTRVRAIAAAAGVAFCAAASHAQAQAVRPGADARQPGSQVNGDTAAGGTLPAISVSAGAERDASVGLVARRSTTGTKTDTPIVEIPQTINIVTAQQIEATGATDINQAFRYIPGFSTYGSDNRSDWYAALRGFTPTVFVDGLQVPNTINLSSWRVDPYMIDSIAVLRGPTSVLYGQGDPGAIVDVQSKLANGERIREVGVQVGNYARKQLMFDIGDKIDKDGTLSYRIVGVGRDGNAQTGPLADQRVSFAPSLKWQPNANTSLTLAATYLQDWGDTSSNFLPSRGTVLPNPNGMISDDLYTADANFDHYRKKQWSIGYQFEHKLNPVWTFRQNVRWMHLALDDASVYGGGLDGADPTMATMTRYAGLFQFNYSRFDVDNQAQAKFTTGPLSHTLLFGFDYNRQTTTDSEWLAKGPGLNLYRPVYTPIPADIFSGPNAYPRTDTKTTLNAFGLYVQDQIKWQRWVLTLGGRQDWTRTSQDDIANSASFKQNDHAFSGRVGLTYLGDYGLAPYLSYSTSFNPQIGVKLAGGGLATPTKGRQIEAGLRWQPPGKNLMLNAAVYQINQTNVAMSNPNDPTSSTFVQVGEVRSRGVELSAVGNLSRELSVIAAYVYQDVKNVQANDNTLNKWPVDVPRPRQIASLWADWTWRNGPLTGFGVGAGVRYMSAAAGAADNSLTVPSYTLFDAALHYELRNWRFALNATNLFNRRYVAGCQSDSVCMYGNQRTVIATAKYNW

SEQ ID NO: 2 - protein, 510 aa, Burkholderia thailandensis
MNKTNINERIARVAKIAAASGLLVALLAACAVGPDYRRPDVATPAAFKEAPALAPGEQAGTWKTAEPADDAHRGEWWRVFGDPALDALETQALAANQNLKAAAARVEQARAATRAARSQWFPQVGVGFGPTREGLSPASQFQPQGSGPTNATLWRAQGTVSYEADLFGRVGRNVEASRADEAQSQALFRSVQLALQADVAQNYFELRRLDSDQDLYRRTVELREEALKLVQRRFSEGDISELDVSRAKNELATAQADSVGVARRRAASEHALAILLGKAPADFSFKETPIVPVAVRVPAGLPSALLERRPDIAAAERAMMAANARIGLAKSAYFPKLDITGSFGYEAATLGNLFLWSSRTFLLGPFAGTALTLPIFDGGRRSAGVAQARAKYDEEVANYRQQVLVAFREVEDNLADLRLLDDQIRAQSDAVNASRRAAKLSRTQYQEGAVSYLEVIDSERSVLESQLQSNQLTGTQAVSTVNLIRALGGGWGNDVAVGSREPNKQDVAAR

SEQ ID NO: 3 - protein, 772 aa, Burkholderia thailandensis
MGGTHHAAAVASPDRVTPGEEIPPMKSRSDELKLGKFTTLCSVLAASPAFAQDAAPPAATADHDKELAPIQVKGAAERSYKADFSSSVKFTAPLVDTPKSVTVIPPELIHDSGAATLTEALRTVPGITFGAGEGGNPLGDRPFIRGYDTQGSLFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVTASYYHLSTDDLPDGGIPYFYTASNKPANVDTIYPANVDRHNFYGLVDRDFRKTTSDIGTLRIEHDITPSLTVRNTTRYTESTQDYIWTQPDDSQGNVINGRVWRRNNNRNSAINSIANQTELFGEFRTGPFKHSFTTGIELSREWGKRDSYSVATGTGKICQQGIGAASGYNCTSLWSPNPNDPWAGSIRRNNDYAHARTVTKSLYGFDTVELSKHWQVNAGVRIDDYSTRFTDTRANGGKTYTRDDTLVNWQLGLVFKPAPNGSIYASYATSSTPAGALLGEGAETQSLTPGRGGVGSNADQLAPEKNRSIELGTKWNVLDDKLALTAALFQIDTTNARVTLPNNQYAMVGSKRVQGLELGFSGRLTRAWQVFGGYTYLKSELRENGKNTADKGHQFPNTPKHSFTLWTNYDVTPKFTVGGGAFYMSKVFGDTANLRAVPSYWRFDAMAQYRINKKLDVRLNVNNLFNRTYFDQAYPAHYASIAPGRSAFVTLNARY

SEQ ID NO: 4 - protein, 766 aa, Burkholderia thailandensis
MHQPLLARRPLRAALFGAFGLYAAAARAAGAASEPAAAAPPSAASAPQVRHAASAATRGNARALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLKRIEILRGPASSLYGSDGLTGAVNFITKDPSDLLSIHGKKTYFSLRPSYDSVDRSVGAAVAAAGGNDRVQGMLIASGRRGHEVDTRGGDNSASTKRTTANPQDVYTESLLGKLTITPTPRDTFKLTAETVRRRIDTNVLSAINPPTTLGLTANDKLERNRLSIDYDFRDDASRWFQTAHVQLYYQESKQDQDAFETRGGRLQSRSRSNHYSERAFGGSAFAESGFATGPLAHKLLYGVDGSIDRIKSLRDGAVASPGESFPNKAFPDTDYTLFGAFVQDQIGFGKLLVTPGLRFDAYRLSPSAGDPLFTGKTVSSSDHELSPRLAVLYEVTPALIPYAQYAHGFRTPTPDQVNNSFSNPIYGYTSIGNPNLKPETSDTLEAGLRGTLGTGYGPLRYGVAAFAGRYRNFIAQRMIGGSGRPNDPLVFQYVNFTNARIHGFEGRAEWVMPNGFTLKTAMAFTKGTTRDNGAASEPLDTVNPFSAVFGVRYEPSERWFAQADLLLQAGKRGRDVSSAACREKTCFTPPSSFVVDLRGGYHFNKHVSAYLGIHNLFDRKYWNWSDVRGIAADSNVLDAYTAPGRSVAVSMKVDF

SEQ ID NO: 5 - protein, 747 aa, Burkholderia thailandensis
MQYEVAGPERSRRVAAPVGRFGGRRWRSSLCLGMLIAAHPGAAALAGTAAKSDTQKNESVQEGTRQRAAGARPAGGELKAISVSASKDAADDPSIATVGKMPLALREIAQSVSVTTRERIEQQNLFSLDDVMQQSAGVTVQPYVLLTTAYFVRGFKVDSFELDGVPVVLGDMASSPQDMSVYERVEILRGANGLLHGSGNPAATVNLVRKRPQYQFAANASASIGSWGRYRAQADIGGPLNPAGTVRGRLVAAYEDRGFFYDRAKQDTRSIYGIAEIDVTRDTLVTVGAQYQSVASVPDMSGVPMARDGSSLGLSRSTFLDVGWGHFDWDTTRAFGSVEQKLGGGWKALVSGEYQAVRSDLKYAGSYGAIDRATGAGGTLMGGAYQFSGYSRSVDANVQGPVRAFGLAHELLFGATYASSSNGQLSAPLLAGAGTPVNVYRWNPDSVPEPGIGPYRQDMQNDISQKGVYGLGRIKLAQPVTLVLGGRVSWWSQDSLGAHYNAGRQFTPYGGLIWDVARDWSWYASYAEVFQPQTKPTWDGSILTPVKGRTYETGIKGELSGGKLNVSLAAFRIDLDNNPQVDAAHPCAGRSCYYVNGGSVRSQGFEFEANGRITPWWSVWASYTFDTIRYAKDVANGGAFAAELTPRHLLRLWTNYDLPWQERRWSIGGGVQVQSDFSAASNGVTMRQGGYALASVRLGYRYDRQWSAALNVNNLFDRTYYQSLSQPGWNNRYGEPRNVMLTVRGQF

SEQ ID NO: 6 - protein, 822 aa, Burkholderia thailandensis
MQAGPGSSHADDRRSAARAMPSRLRESTSSEQSEAGGKRSGPRGADDSGACGVRSGGGGGRGNPSMSRAQHAPSRRRAFERSFAAAAARAAHGAPAAHGPHACLAAASRRSTAVERCVTALACAVTASGALAADADPAESARDPHRELPTVRVTSDAAHASPLSTPLTAGSRLKLASLDMPASVEAITSGQMAARGDRTIVDAVTRATGFSTAAAPGNGGTALSVRGFAGQESVTTLVDGVRLYPGAGTVTFPFSTWSAERIEVLRGPASVLHGEGAIGGVVDVVTRRPRRERSTTLQASIGTQGEKRVALDTTGALGPRLSYRFHLSDERTRGFVERGDAHATAVGGALKLDVDSRLSITLDYDYGRQKPATYFGVPAANGVLDRALRERNYNVGDATIAYHDTWTRLAATYRAGNGVTLDAQLYYLATRRHWRNAESYALDAAARTVARSDYLEIFHRERQFGERFTARIDSRVFGRANRLVVGAEFNQIAFDGANNAPYRGESTVAAAGFDPGAFASPDPTLPRFRTRTHQAAAFIENRLEVLPRLAWVSGLRYDHLSFHRDDLVAGGAFDKTFAHTGWRSGLVYEIAPGLTAYAQYTTGAEGVGSLVTLPASQANYTLATGRQWEAGVKHEIDDARAYWTLAVYDIVKRGLVSVDPLNPARAQQIGRQSSRGVELAGGVRLPGGVTIDANAALLRARYDAFGQRVGDTVVQRAGNVPHDIARQTANLWIGWAFAPGWRANAGLRYVGRRYGDDANRVPVPSYTVFDASLAWQATRDVGLALYARNLANRTYAASTSNGGAQWLLGPSRSAELVATLRF

SEQ ID NO: 7 - protein, 753 aa, Burkholderia thailandensis
MTIKFLRHAHPARVDRARRRRRAITLTVPALAAGAFHLAPAVAQTDDAVHRHGALGATSGVANDAARGASSAKSNARANEATAVTRSATNRATAGAAPEAAMLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTVVKGPQTVLYGPGASAGTVLFERVTPRFKTPGMRFDGSVVGGSFGRNDQNVDVTAGTPDFYGRVIANHAHSQDYEDGNGRTVPSQWDKWNADAALGWTPDDNTRLELTAGTGDGYARYAGRGMDGAHFRRETFGLTFDKKHIGDVLDRIEAQVFYNEADHVMDNYTLRMPDPTSSMPMRMASEVRRRTLGARVAATLRFTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGAVNAFSAIKPEKTTQLDIGAQYKSDKLDAWVSAYAGYVQDFILFDYATGSMGQTTQATNVNAQIMGGELGASWRPLAPWRFDASLAYAWGRNVQSGAPLPQMPPLEARFGVEYTRGPWSAGGLWRIVAPQHRYALNEGNVVGKDFGPSAGFGVLSLHAQYNVSKAVQISVGIDNVLDKAYAEHLNLAGNAGFGYPANMPVTEPGRTAWVRLSTKL

SEQ ID NO: 8 - protein, 742 aa, Burkholderia thailandensis
MQSPGLHGRADAAAALDRLLTGTGLVALRQPSGGYTLVRSPAGPAAPSAGAALATDTTLPTVSVRASGLHADSYRAPREAAGLRSDAPLAEVPQAVNIVAPQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLTRHNAISVLGSTYGHGRNGGELTFDSTGAIGDSRLAYRLIVDQTNEQYWRDYGEHRETLVAPSLAWYGRDTQVVLSYEYRRFLMPFDRGTALDPRTNEPLAIPARRRLDEPFNDMRGESNLVQLTVDHQLAPNWKAHLGYSYNRETYDANQIRITAVDPVKGTLTRSNDATHGSRSTDSYAIAYVDGRVTLAGMRHDVQFGVDSEYRQVYRADMLRQAIKTPFSYLNPTYGLIPPSTSVSASDSDQSDTLHTASLFFQDSIHLTDKWILVGGARFVRYSQLAGRGRPFRVNTNLSGTKWLPRAGIVYKWNDALSLYGSYTQSLKPTSKIAPMSGGYVIDGSTAPEQGASWELGAKLDLPSGFAGTLAFFEIDKKNVLVSQYNDATNQTDWRTSGRARSRGIELDVSGRIGERWNVIASYAYIDAKTTEDPLYAGNRLWNVARHTASLAAVYDAGAVFGGDDLRIGAAGRYVGARPGDSANSFTLPAYATADAFATYDTRVGKQKLQFQLNVKNLFNRTYYPSSVNRFFVSVGDARQVSLLTTLQF

SEQ ID NO: 9 - protein, 261 aa, Burkholderia thailandensis
MKTAPAPDAGRIEALARLHDRRRAGRPRRKSSSFLFLSSHSREETKMNTKIATRLSVFALAGALLAGCATQQGTNTAVGTGTGAALGAGIGALAGGGKGAAIGAGVGALVGGVTGYNWQAIKNKLAPSAQQTGTQVTEQPDGSLKLNVPSSVTFATDQYAVTPAFTPLLNDLATTLNQNPQITASVVGYTDSTGSAAHNQTLSQNRAQSVVNALAQRGVAATRLSAQGMGASNPIADNATEAGRAQNRRVEIYLRAPQAAQ

SEQ ID NO: 10 - protein, 170 aa, Burkholderia thailandensis
MMSKKLRLAFAMLMIGALAACKSGVKLDEHANQGGAVSTQPNPENVAQVTVDPLNDPNSPLAKRSVYFDFDSYSVQDQYQPLLQQHAQYLKSHPQRHILIQGNTDERGTSEYNLALGQKRAEAVRRALSLLGVGDSQMEAVSLGKEKPVALGHDEASWAQNRRADLVYQQ

SEQ ID NO: 11 - protein, 224 aa, Burkholderia thailandensis
MNKLSKLAFIAATAVMAASASAQSVPASRQAVNDNWVNGTGEWVWMNGTNELCWRDAFWTPATANAKCDGALVAQAPAPAPVAPVAPAITSQKITYQADTLFDFDKAILKPAGKQKLDELAAKIQGMNVEVVVATGYTDRIGSDKYNDRLSLRRAQAVKSYLVSKGVPANKVYTEGKGKRNPITGNTCKQKNRKQLIACLAPDRRVEVEVVGTQEVQKTTVPAK

SEQ ID NO: 12 - protein, 379 aa, Burkholderia thailandensis
MKKTLIVAALSGVFATAAHAQSSVTLYGLIDAGITYTNNQGGHSAWSQSSGSVNGSRWGLRGAEDLGGGLKAIFVLENGFGINNGTLKQNGREFGRQAFVGLSHDQYGSLTLGRQYDSVVDYIGPLSLTGTQFGGVQFAHPFDNDNLNNSFRINNAVKYTSVNWAGLKFGALYGFSNSNEFANNRAYSAGVSYSYAGFNVGAGYLQLNNDFGPTVSNASGAVALDNTFVGKRQRVFGGGLNYTYGPATAGFVFTQSRVNRATAISSGASGVSSGIALDGTFMRFNNYEVNARYAITPAWTVAGSYTYTAGFIENHHPGWNQFNLQTAYALSKRTDVYLQGVYQKVNSDGTGLGAYINGVGGMSSSEKQIAVTAGLRHRF

SEQ ID NO: 13 - protein, 414 aa, Burkholderia thailandensis
MPRNGAQKRRTHRGGPTSARPPNQGLEISIMKKHIISAAALLAFAAPVFAQSSVTLYGVIDEGFNYTSNVNVNGVGKSNYQLASGFAQGSRWGLRGSEDLGGGLKAVFTLENGFDVNNGRLGQGGRMFGRQAFVGLSHAQYGSLTLGRQYDSVVDYLAPLTANGNWGGLLFSHPFDNDNTDNSFRVNNTIKYASPDWNGLQVGGTYSFSNATGFSNNRQYSIGAAYTLGGLQLAAAYLQANNPGKTAGGAIADNDANFTADRLRIFGGGVNYTFGPATVGFVYTKTDVKNPVSTVYLPTATFAGLGLTATKFQNFEINGKYQLTPALFIGAQYVYTDGKFDAAAGTVKPKYHTIGLMADYNLSKRTDVYLQGAYQKVAGDKTGTIADGGYVVGTDGPSASANQFAVRAAIRHKF

SEQ ID NO: 14 - protein, 374 aa, Burkholderia thailandensis
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTIRADNYEANVKYNLTPALGLGVAYTYTNAKANGESAHWNQVGVQADYALSKRTDVYAQAVYQRSSKNANASIYNGDLSTPFSTSINQTAATVGLRHRF

SEQ ID NO: 15 - protein, 523 aa, Burkholderia thailandensis
MRVLRPSKRPARSTAHLARKDAGVVSEQSAAFERAPVAIAATATPANVCMHRLCCENSPKTAPHTSNMLASATIATQPSASVPGIEMVVYVIDIKRLFIAVTFLRHFIFLDFLHLMQCAILQSATNNDSLAWRNSSMKKLALSTLSLALLGAAGAAQAQSSVTLYGVIDTSITYVHGNDGKANNAWQMGSGNLQGARWGLKGTEDLGGGLKAIFQLENGFNSANGALGQGSRMFGRQAFVGVQSDTYGTLTLGRQYDPLVDLVQPVTADNYFGSLFATPGDVDNNDNSLRVNNTVKYTSPVFAGFQFEALYGFSGIAGSPGTGQTWAAAAAYNNGPVGIGAGYFHASNSAPLSAAGVRTGWGGSSDAIFDGPDNSLFMNNGYATAKSIGIAQVGAQYVFGPFTFGLGYSNAQYKSDSASAFGSTEKYNTGRGFVTYQATSALLLGLGYIYTKSSGDSNAKYHQVSLGADYSLSKRTDVYLAGAYQHASGTQAGGGDAQASIGSYGIGGTKSQEMVALGLRHKF

SEQ ID NO: 16 - protein, 544 aa, Burkholderia thailandensis
MRRPRGRHRSASPRRRARGTGDQVKTMMKPLARQGGPHGSRRPGGLRAWPAALAAALVTGCTLAPRYERPAAPVPANYLPAAAGAPRAASPAAAGSGARDAQPASDARGGGNVQEMHDVRLDDWRAYFTDPALRALIDAALANNRDLRIATLRIEEARGLYGVARADRLPSIDGSLGYERTRLYDPVLRESATSSLYRASVGLSAFEIDLFGRVKSLSDAALAEYFATAEAQRAARVSLIAEVASAYVRERALVDQLKLAERTLAARDATYALTQRRYAAGTSTAIELRTAEMLVASARASKAALEREHTQAASALKLLAGDFTAALPADAPALDELAVARVSPGLSSDLLEQRPDIRQAEQRLVAANANIGAARAAFFPRIALTTDIGSVSDAFSGLFSAGSSVWTFAPRLTLPIFAGGRNRANLDVADARKHIAVAEYEKTIQTAFREVADALAARDQIDAQLAAQQAVYGADAERLRLAERRYGSGVASYLELLDAQRSTFESGQELIRLKQLRLTNAITLYRALGGGWSRAACGGEDACA

SEQ ID NO: 17 - protein, 519 aa, Burkholderia thailandensis
MKRKHALTALAVALLAAGCTLAPRYERPAAPVSGAFPTDGVYAAQPGAAAGARSANGQAAVDIGWREFFVDPRLQRLIEIALKNNRDLRVSVLNVEASRAQYRITRAGLFPTLDGTGTGTIQRTPAGVSVTGQPLISRTYNVGVSASWELDLFGRVQSLKDQALAQYFATAQARKAAEISLVASVADQYLTLLSTDDLLQITENTLKTARASYDLTKLQFDNGTGSELDLRQAQTVVETALANQQAQARARAQAVNALVLLIGEPLPDDLPAGLPLNAQNLLTDIPAGLPSDLLTRRPDIMQAEETLRAANANIGAARAAFFPKISLTGAFGTASPTLGGLFKAGTAAWSFAPSIALPIFEGGQNIANLDLAHVQKRIEIANYEKAIQSAFREVSDGLAARGTYDQQIAALERNEHAQQRRYDLSDLRYKNGVDSYLSVLTAQTDLYSAQQQLISARLARWTNLVDLYRALGGGWIERAGETPRPADAPVDYGKAAAPAPASASASAAPAAAASAPAAG

SEQ ID NO: 18 - protein, 224 aa, Burkholderia thailandensis
MASEDRQDSGRERVNRNDFQAGFQSGLFDAANPFHLSDIERIRPWLFANERLSFRNSSPHTSQGTNMQGDKKVIEYLNAQLKNELTAINQYFLHARMYKHWGLEKLGKHEYDESIGEMKHADWLIERVFMLDGLPNLQDLHKLLIGEETEEILKCDLKLEQVSQATCKEAIAYCESVRDYVSREIFEKILDDTEEHIDWLETQIDLIGKVGIQNYQQSMMGSPE

SEQ ID NO: 19 - protein, 79 aa, Burkholderia thailandensis
MIVCVCKSVSDRKIRASLAEGVNTFEELQFELGVATCCGKCEETVREIMAEQGVCASRCGVEPPAAVPVPVTFYERKAA

SEQ ID NO: 20 - protein, 327 aa, Burkholderia thailandensis
MGRIGYRRRAARSRAASRGKRMLNFLVKRLFGLLPTLACVAVLVFLFVHLLPGDPARLAAGPEADDATVALVRADLGLDKPLPAQFASFFARIAQGDFGVSTRSKRPVATEIGERFMPTLSLTVVSMAWATLFGMAIGIASAVWRNRWPDRVGMTLAVSGISFPAFALGMLLMEVFSVKLGWLPVVPDGSWKSYVLPSLTLGAAVAAVMARFTRASFIEVLNEDFVRTARAKGVREPMVVLKHCLRNAMIPVVTMMGLQFGFLLGGSIVVEAVFNWPGLGRLLVDAVTMRDYPVIQAIVLLFSLEFILINLTVDVLYAVINPTIRFK

SEQ ID NO: 21 - protein, 400 aa, Burkholderia thailandensis
MKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYMSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSAFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 22 - protein, 527 aa, Burkholderia thailandensis
MPQQVIQTDKCKEILAVSIIHSESGNTAMKTFPLSACRTATAVAVAVLALAGCANYFGIKSDKAIAPATQFESAQSLPAQGGRWPSLDWANQFGDPQLPKLIDEALEGNPTIAQAQARIAKASSYIESSRSTLLPKADAKYSWTRELYSSNALVPPPFGGQWYSENNALASASWELDLWGKNRARLNAAVSQEKAAEADMQQARVTLATSVARTYNQLAQLYALRDIAEREISNRQTVGKITDGRVGAGLDTNVERQTALGNIATSQSTLSDLDGQITNVRYQLAALLGKGPDRGLQIAAPVLSPGGGVALPDNLPADLVSRRPDLVAARWQVEAAMHDVKEAKAEFFPDINLAAGLGFDAFGWGRFLNFASRQAQFGPAIHLPIFDGGALRAQLKGRYADFDLSVANYNQTLVSALNDVATQVASIRSIDTQMGDAQRALDASTRAYELAVIRYKAGLSPQLQVLNADSNRLAAEQTVTNLKMRRRDLQIGLVKALGGGFDATGTRLATPAPAVAAAAAPARHASN

SEQ ID NO: 23 - protein, 778 aa, Burkholderia thailandensis
MSHELAAHVARTRLAAACVAAFAWPAAHAVTTGAAVPADSTSAAAAETTASGKTLDIVRVTAQRPAFASDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTRKPDRLEASVSTQFFTQRYRDGYGFADSFGGNHQTARVADRVGRFWYALSLDRLENDSQPMQYASPNGTFDPRLGASVPVTGAVSDIGPNGRPRTIVGAQTIERTEQLNETLRFGYAFTDHVDATVTLGHWENHYRQHGDTFLRDAAGNPVYGGNVSFGGRSYTVSPTAFAPQTGDQENWLYGLGLDARLASGWKLSATASAYEVSRDVLRSASGAPTGAWDGGPGTVFHGDGTGWRTVDLRAESPDVRGHRFSFGYHFDTYFLRNATYNTADWQNAVPTTLANRYRGNTRTQALYAQDAWRFAPGWLATLGLRYERWDAYGGQLGNANATLGYAGRGATALSPKLALEWQPTDAWRLRLSFATGTRFPTVAELFQGTISNNAIVNNNPNLQPEKAIDWDFTAERDVGFGVVRTSVFQSDLRNSIYSQTTVAGASTYTNISNVDRVRVRGVELAFSGQDVAIKGLDVDANVSATNAQTLADAANPNYVGARWPRIPRMRANLLASYRFGEHWMTSVGVRYSGRQYNALDNSDVNPNVYGGTSSFAVVDLKARYRFDRHWLASFGIDNVTDRRYYVFHPYPGRTFYGELKWSL

SEQ ID NO: 24 - protein, 725 aa, Burkholderia thailandensis
MIRYIVSLSARDSARDSVHPENTAPITAMDHHRRIAPPSARRLHPLSLLLAASLAHGETGEPAGRPSSAPPATALAPIFVTANPLGASALTSPTASLSGDALTLRRADSLGDMLNGLPGVSTTTYGPLVGRPIIRGMDGDRIRLLQNGVAAYDASSLSYDHAVPQDPLSVERVEIVRGPAALLYGGNAVGGVVNTIDNRIPREAVTGVTGALDASYGGANNARAGAALVEGGNGRFAFHLDAFGRETDELRIPGYAHSARQRARDGEDASEPYGKLPNSDGRRYGGAAGGSYTWADGYVGASYSGYESNYGSVAETDARLRMRQERVAIASEARNLRGPFSQLKFDFGYTNYLHREIEDGVTGTTFRNHGYEARVEARHRKLGPFEGALGVQVGQNTFSALGGEALAPTTRTTSVALFGLEEWQATDALKLSAGARIEHVRLDPSANGDDKFGVARSRDFNAGSVSAGALYQLAPAWSVAGNVSYTERAPTFYELYANGPHGATGQYLIGLPDARKEKAVSTDLALRYANGPNRGSVGVFYSRLRNYLAEYDTGRLVDDEGAPVAPGGDETLREAVYRGVRAEFYGVELEGKWRAFEKRGHRIDLELGADYTHARNADTGEPLPRIAPLRATLAADYGYGPFGARAQLTHAWAQHRVPENDLATDGYTSLGVVLTYKFRVGATNWLAYLRGDNLTNQDIRYASSVVRNIAPQGGRSVTVGMRTTF

SEQ ID NO: 25 - protein, 420 aa, Burkholderia thailandensis
MRVERVPYRLITVATAAVFLAACGKKESAPPPQTPEVGVVTVQPQAVPVVSELPGRTSAYLVAQVRARVDGIVLRREFTEGSDVKAGQRLYKIDPAPYIAQLNSAKATLAKAQANLATQNALVARYKVLVAANAVSKQDYDNAVATQGQAAADVAAGKAAVDTAQINLGYTDVVSPITGRVGISQVTPGAYVQASQATLMSTVQQLDPVYVDLTQSSLDGLKLRQDIQSGRIKTEGPGAAKVTLILEDGKAYSEPGKLQFSDVTVDQTTGSVTIRAIFPNKQRVLLPGMFVRARIEEGVNDNAFLVPQIGVTRDPKGQAVAMIVDGKGKVEPRVLTTSGTQGQNWVVEGGLQAGDRVIVQGIDKVRPGMTVKTAEAQLPAAASGASGAAPAGGSPAQAAAASAAASGAAPSSAAAASSAK

SEQ ID NO: 26 - DNA, 2217 bp, Burkholderia thailandensis
ttaccagttgtatttcgccgtcgcgatcacggtgcgctggttgccgtacatgcacaccgaatccgactggcagccggccacgtagcggcggttgaacaggttcgtcgcattgagcgcgaagcgccagttgcgcagctcgtagtgcagcgccgcgtcgaacagcgtgtagctcggcaccgtcagcgagttgtcggcggcgcccgccgccgcgctcatgtagcgcacgcccgcgccgacgccgaagcccgtgagcggcccgttgcgccacgtccagtcggcccacagcgacgcgatctggcgcgggcgcggcacgtcgacgggccacttgttcagcgtgttgtcattcgcctgcacgttcttcacgtcctgatagacgtacgcggcgatcaccgacagctcgcgcgacaggttgcccaccgcgctcagctcgacgccgcgcgagcgcacctcgcccacctgcacgaacgtgctgctcgtcggatcgttcggattgctcatcgcgacgttcgtctggttgatctggtagacggccgcgttcagcatcaggttcttgcccggcggctgccagcgcaggccagcctcgatctggcggcccttggtcggcgtcgcgagcccgccgcccgcgagcttcacgccgatctgcggattgaacgacgtcgaatagctgaggtacggcgcgaggccgtaatcgccgagataggtcaggccgacgcgcccgctgaacgcgtggtcgttctgcttgaagctcgccgagttcgcgatgtcgtcctgcgacgtgcgcgtccagtcctgccggccgccgagcgtgagcacccagcgctgccacttgatctggtcctgcacgtacaggccgaaggcgttgagcgtcgtcttcgtgtcggtgcgcgggtacgcgttcggcccgctgaagatgtcggccggaatcggcgtgtagacgggccggtacaggttcaggccgggccccttcgcgagccattcgctgtcggtcgtcgtctgccggttgtagtcgaagccgaacagcagtgtgtggctcaacgggcctgtcgtgaatttcgcctgcgcctggttgtcgacgtcgaagcggctgtagttgaactggaacaggcccgcgtagcgcgtcatcgtcgccatcgtcgggtccgcgccgtcgaggccgccgccgtagacggacgcgtcgtcgagcgccaggtgcatccagcgcacgttctgccggaacgtccacaccgggttcagcttgtgctcgaactgatagccgatcgaccattgcttcttgcggtagtggtcgaagttcgcatcggccgtgtacaggtcgtccgagatcatgccgttcggattcggcagcacggtgccgcgcgacggcaggaagttgctcgacgtgtcgccccagtcctgcaggtacgtcgcggcgagcgtgagcgacgtgtttgcgttcggctgccacttgagcgacggcgcgaacgacacgcgctggtcggcgagcggccccgtctgcgcgttgccgtcgcggccgacgccgacgatccggtacgacagcgtgccatccttgtcgatcttgtcgccgatatcgaacatcagctgcttgcgcgcgtagttgcccacctgcacgccgacctcgcgaatgcgctcgccgttcgcgagcttgctctgcacgtcgacgatcgcgcccgggtcgccctgcccgtacagcaccgacgtcgggccgcgcagcacggcgatgctgtcgatcatgtacggatcgacgcgccagctcgacaggttgatcgtgttcggcacctgcagcccgtcgacgaacacggtcggcgtgaagccgcgcagcgccgcgtaccagtccgagcggttgtccgatccgtaggtcgagaagcccgggatgtagcggaacgcctgattgatgtcggtcgcgcccgtcgcctcgatctgctgcgcggtgacgatgttgatcgtctgcgggatctcgacgatcggcgtatcggtcttcgtgcccgtggtgctgcgccgcgcgacgaggccgacgctcgcgtcgcgctccgcccccgccgacaccgagatcgcgggcaacgtgccgcccgccgcagtgtccccattcacctgactgcccggctgccgcgcgtctgcccccggccgcaccgcctgtgcctgcgcatgactcgccgccgcgcagaacgccacgcctgccgcggccgcgatcgcacgcacgcgcgtgctggttgcccactccat

SEQ ID NO: 27 - DNA, 1533 bp, Burkholderia thailandensis
tcaacgtgccgcgacgtcctgcttgttcggctcgcgcgaaccgacggccacgtcgtttccccaaccgccgccgagcgcgcgaatcaggttgaccgtcgataccgcctgcgtgcccgtcagctgattcgactgcaattgcgactcgagcaccgagcgctcgctgtcgatcacctcgagatagctgaccgcgccttcctgatactgcgtgcgcgacagcttcgccgcgcgacgcgacgcgttgaccgcatcgctctgcgcgcggatctgatcgtcgagcaaacgcagatcggcgaggttgtcctccacttcgcggaacgcgacgagcacctgctgccgatagttcgcgacttcctcgtcgtacttcgcgcgcgcctgcgcgacgcccgcgctgcggcgtccgccgtcgaagatcggcagcgtgagcgccgtgcccgcgaacggtccgagcaggaacgtgcggctcgaccacaggaacagattgccgagcgtcgccgcttcatagccgaacgaacccgtgatgtcgagcttcgggaaatacgcggacttcgccaggccgatgcgcgcgttcgcggccatcatcgcgcgctcggccgccgcgatgtccggccgccgctcgagcagcgcggacggcaaccccgccggcacgcgcaccgcgaccggcacgatcggcgtttccttgaacgagaaatcagcgggcgccttgccgagcaggatcgcgagcgcgtgctcggacgcggcgcgccgccgtgcgacgccgaccgagtccgcctgagcggtcgcgagctcgttcttcgcgcgcgacacgtcgagctcgctgatgtcgccttcgctgaagcgccgctgcacgagcttcagcgcctcctcgcgcagctcgaccgtgcggcggtacagatcctgatcggaatcgagccggcgcagctcgaagtagttctgcgcgacgtccgcctgcaacgcgagctgcaccgagcggaacagcgcctggctctgcgcttcgtccgcacgcgacgcttcgacgttgcggccgacgcggccgaacagatccgcctcgtacgacaccgtgccctgcgcgcgccagagcgtcgcgttcgtcgggccgctgccctgcggctggaactgcgacgccggcgacagcccctcgcgcgtcggcccgaagcccacgcccacttgcgggaaccactgcgagcgcgcggcgcgggtcgccgcgcgcgcctgctcgacgcgcgccgccgcggccttcaggttctggttcgcggcgagcgcctgcgtttcgagcgcatcgagcgccggatcgccgaatacgcgccaccattcgccgcgatgcgcgtcgtcggcgggctcggccgtcttccacgtgccggcctgctcgcccggcgcgagcgccggcgcttccttgaacgcggcgggcgtcgcgacatccggccgcctgtagtcgggcccgaccgcgcacgcggcaagcagcgcgacgagcagcccgctcgccgccgcgatcttcgcgacgcgcgcgatgcgttcgttgatgttggtcttgttcat

SEQ ID NO: 28 - DNA, 2319 bp, Burkholderia thailandensis
tcagtagcgcgcgttgagcgtgacgaacgccgagcggcccggcgcgatcgacgcgtagtgcgccggataggcctgatcgaagtacgtgcggttgaacaggttgttcacgttgagccggacgtcgagcttcttgttgatccggtattgcgccatcgcgtcgaagcgccagtacgacggcaccgcgcgcaggttcgcggtgtcgccgaacaccttcgacatgtagaacgcgccgccgccgaccgtgaacttcggcgtcacgtcgtagttcgtccatagcgtgaagctgtgcttcggcgtgttcgggaactggtggcccttgtccgccgtgttcttgccgttctcgcgcagctcgctcttcaggtacgtgtagccgccgaacacctgccacgcgcgcgtgagccggccggagaagccgagctcgagcccctgcacgcgcttgctgccgaccatcgcgtactggttgttcggcagcgtgacgcgcgcgttcgtcgtgtcgatctgaaagagggcggccgtgagcgcgagcttgtcgtcgagcacgttccacttggtgccgagctcgatgctgcggttcttctccggcgcgagctggtcggcgttcgagccgacgccgcctcggcccggcgtgagcgattgcgtctccgcgccttcgccgagcagcgcgccggcgggcgtcgacgacgtcgcgtacgacgcatagatgctgccgttgggcgccggcttgaacacgaggccgagctgccagttcacgagcgtgtcgtcgcgcgtgtaggtcttgccgccgttcgcgcgggtgtcggtgaagcgggtcgagtagtcgtcgatgcgcacgccggcgttcacctgccaatgcttgctcagctcgaccgtgtcgaagccgtagagcgatttcgtcacggtgcgcgcatgcgcgtagtcgttgttgcgcctgatcgagcccgcccacggatcgttcgggttcggcgaccacaggctcgtgcagttgtagccggacgccgcgccgattccttgctggcagatcttgccggtgccggtcgcgacgctgtacgaatcgcgcttgccccattcgcgcgacagctcgatgccggtcgtgaagctgtgcttgaacgggcccgtgcggaattcgccgaacagctcggtctggttcgcgatgctgttgatcgcgctgttgcggttgttgttgcgccgccagacgcggccgttgatcacgttgccctggctgtcgtcgggctgcgtccagatgtagtcctgcgtcgattccgtgtagcgcgtcgtgttgcgcaccgtcagcgacggcgtgatgtcgtgctcgatccgcagcgtgccgatgtccgacgtcgtcttgcggaagtcgcggtcgacgaggccgtagaagttgtgccgatcgacgttcgccggatagatcgtgtcgacgttcgccggcttgttcgaggccgtgtagaagtacgggatgccgccgtcgggcaggtcgtcggtcgacaggtggtagtagctcgcggtcacgcgggtgggcgtgccgagcccgaacgcgatcgacggcgcgacaccccagcgttcgttgttcaccgcgtcgcggcccgcgacgtcgttgttgtggctcatcaggttcaggcgaaacgccgcgtggtcggcgaactgccagttgccgtccgcggtgaagcggcggtagcggtcggtgccgagccccgcgctcgcctcggctgtcgtgccgagatgcggcgccttcgtgacgaggttgatgctgccgcccgcgccgcctcggccgccgtacgcgccgtccgagcccttcgtgatctcgatgcgctcggtgttgaagatctcgcgcgtcgtcgcgcccgtgtcgcgcatcccgtcgacgaacaggctgccctgcgtgtcgtagccgcggatgaacgggcggtcgccgagcggattgccgccttcgcccgcgccgaacgtgatgccgggcaccgtgcgcagcgcctcggtgagcgtcgccgcgccgctgtcgtggatcagttccggcggaatcacggtgacggatttgggcgtgtcgacgagcggcgcggtgaatttcaccgacgacgagaagtccgccttgtagctgcgctcggcggcgcccttgacctggatcggcgcgagctccttgtcgtgatcggcggttgccgcgggcggcgcggcgtcctgcgcgaacgccgggctcgcggcgagcacgctgcagagggtggtgaattttccgagcttcaactcgtcggaacgcgacttcatcggtggtatttcctcgccaggtgtgactcgatcgggcgaagcaacggccgctgcatgatgcgttccgcccaa

SEQ ID NO: 29 - DNA, 2301 bp, Burkholderia thailandensis
gtgcatcaacctctgctggcgcggcggccgcttcgcgccgcgctgttcggggccttcggcctctacgcggcggccgcgcgcgccgcgggcgccgcctccgaacccgcggccgccgcgccgccgtccgccgcgtccgcaccgcaagtgcgacacgcggcgagcgcggccacacgcggcaacgcgcgcgccctcgacccgatcaccgtcaccgcgacgcgcaccgcgtcggccgcgagccgcaccgcggcgagcgtatcggtaatcaccgattcggacctcgaagaacagcaggccgacaacatcaaggacgcgctgcgctacgagccgggcgtcaccgtgcggcgcaccgcgtaccggccggcgaacgccgcgctcggcggcggccgcgacggcgattcgagcatcaacatccgcggcctcgaaggcaaccgcgtgctgctgatggaagacggcatccggctgccgagcgcgttctcgttcggtccgctcgaagccggccgcggcgattacgccgatctcgacacgctcaagcgcatcgagatcctgcgcggcccggcctcgtcgctgtacggcagcgacggcctgacgggcgccgtcaacttcatcacgaaagatccgtccgatctgctgtcgatccacgggaagaagacctatttctcgttgcggccgagctacgactcggtcgaccgcagcgtcggcgcggccgtggcggcggcgggcggcaacgaccgcgtgcaggggatgctgatcgcatccggccgccgaggccacgaggtcgacacgcgcggcggcgacaattccgcgagcacgaagcgcacgaccgcgaatccccaggatgtctacacggaatcgctgctcggcaagctgacgatcacgccgacgccacgcgacacgttcaagctcaccgccgagacggtgcggcgccggatcgacacgaacgtactgtcggcgatcaatccgccgacgacgctcggcctcaccgcgaacgacaagctcgagcgcaaccgcctgagcatcgactacgatttccgcgacgacgcgtcacgctggttccagaccgcgcacgtgcagctctactaccaggaatcgaaacaggatcaggacgcgttcgagacgcgcggcggccgcctgcaatcgcgctctcgctcgaaccattacagcgagcgcgcgttcggcggctccgcgttcgccgagagcggcttcgcgaccgggccgctcgcgcacaagctgctgtacggcgtcgacggcagcatcgaccgcatcaagagcctgcgtgacggcgccgtcgcgagccccggcgagtcgttcccgaacaaggcgtttccggacaccgactacacgctgttcggcgcgttcgtgcaggaccagatcggcttcggcaagctgctcgtcacgccgggcctacgcttcgacgcatatcggctgagcccgagcgcgggcgatccgctcttcaccggcaagacggtcagctcgagcgatcacgagctgtcgccgcgcctcgcggtgctgtacgaggtgacgcccgcgctgatcccgtatgcgcagtacgcgcacggctttcgcacgccaacgcccgaccaggtcaacaacagcttctcgaatccgatctatggctatacatcgatcggcaatccgaacctgaagcccgagacgagcgacacgctcgaagcgggcctgcgcggcacgctcggcacggggtacgggccgctgcgctacggcgtcgccgcgttcgccggccgctatcggaacttcatcgcgcagcgcatgatcggcggcagcggccggccgaacgatccgctcgtgttccagtacgtgaacttcacgaacgcgcgcatccacggcttcgaagggcgcgccgagtgggtgatgcccaacggcttcacgctgaagaccgcgatggcgttcacgaagggcacgacgcgggacaacggcgcggcaagcgagccgctcgacacggtcaacccgttctccgccgtgttcggcgtgcgctacgagccgagcgagcgctggttcgcgcaggccgacctgctgttgcaggcgggcaagcgcggccgcgacgtgtcgtcggccgcgtgccgggagaagacgtgcttcacgccgccgtcgtcgttcgtcgtcgatctgcgcggcggctatcacttcaacaagcacgtgagcgcctacctcggcattcacaacctgttcgaccgcaaatactggaactggtcggacgtgcgcggcatcgccgccgattcgaacgtgctcgacgcatacaccgctccgggccgcagcgtcgcggtcagcatgaaggtggatttctga

SEQ ID NO: 30 - DNA, 2244 bp, Burkholderia thailandensis
tcagaactgcccgcgcacggtcagcatcacgttgcgcggctccccatagcgattgttccagccgggctggctgagactctggtagtaagtgcggtcgaacaggttgttgacgttgagcgcggcgctccattgcctgtcgtagcgatagccgagccgcacgctcgcgagcgcgtagccgccctgtcgcatcgtgacgccgttcgacgccgccgagaaatcgctctgcacctgcacgccgccgccgatgctccagcggcgttcctgccacggcaggtcgtagttcgtccacaagcgcagcaggtggcgcggcgtgagctccgccgcgaacgcgccgccgttggcgacgtccttcgcatagcggatcgtgtcgaacgtgtagctcgcccacacgctccaccacggcgtgatgcgcccgttcgcctcgaattcgaagccctggctgcgcacgctgccgccgttcacgtagtagcagctccgcccggcgcatggatgtgcggcatcgacctgcggattgttatcgagatcgatgcgaaacgccgcgagcgacacgttgagcttgccgcccgacagctcgcccttgataccggtctcgtaggtgcggcccttcaccggcgtcaggatgctgccgtcccaggtcggcttggtctgcggctggaacacttccgcatagctcgcgtaccacgaccagtcgcgcgcgacatcccagatcagcccgccatacggcgtgaactggcggcccgcgttgtagtgcgcgccgaggctgtcctggctccaccagctcacgcgcccgcccagcacgagcgtgaccggctgcgcgagcttgatgcggccgaggccgtagacgcccttttgcgagatgtcgttctgcatgtcctgccggtacggcccgatacccggctccggcacgctgtccggattccagcggtacacgttcaccggcgtgccggcgcccgccagcagcggcgcgctgagctgcccgttgctgctgctcgcgtaggttgcgccgaacagcagttcgtgcgcgagcccgaacgcgcgcaccgggccctgcacgttcgcatcgacgctgcggctatagccgctgaactggtatgcgcctcccatcagcgtgccgcccgcacccgtggcccgatcgatcgcgccgtacgagcccgcgtatttcaggtcggagcgcaccgcctgatactcgccgctcaccagtgccttccagccgccgccgagcttctgctcgaccgagccgaacgcgcgcgtcgtatcccagtcgaagtggccccagccgacgtcgaggaatgtcgatcgcgacaggccgaggctcgagccgtcgcgcgccatcggcacgccggacatgtcgggcaccgacgcgaccgactggtattgcgcgccgaccgtgacgagcgtgtcgcgcgtcacgtcgatctcggcgatgccgtagatcgagcgcgtatcctgcttcgcgcgatcgtaaaagaagccgcggtcctcgtacgcggcgacgagccgcccgcgcaccgtgcccgccgggttcagcggcccgccgatgtcggcctgcgctcggtagcgcccccaactgccgatgctcgcgctcgcgttcgcggcaaactgatattgcggccgcttgcgcaccagattgacggtcgcggccggattgcccgagccgtgcagcaagccgttcgcgccgcgcaggatctccacccgctcgtacaccgacatgtcctgcggcgagctcgccatgtcgccgagcacgacgggcacgccgtcgagctcgaacgaatccaccttgaagccgcgcacgaagtacgcggtcgtcagcagcacgtatggctgcacggtcacgccggccgactgctgcatcacgtcgtcgaggctgaacaggttctgctgctcgatccgctcgcgcgtcgtcacactgaccgattgcgcaatctcccgcagcgcgagcggcatcttgccgacagtcgcgatcgacgggtcgtccgccgcatccttcgacgcgcttaccgaaatcgccttcaactcgccgccggccggccgtgcgccggcggctcgctgccgcgtgccttcctgcacgctctcgttcttttgcgtgtcgctcttcgcggccgtgccggcaagcgccgccgcaccggggtgggccgcgatcagcatgcccaggcaaagcgacgaacgccaccgccttcccccgaaacgcccaaccggcgcggccacgcgccgcgatctctcaggtcccgccacctcgtactgcat

SEQ ID NO: 31 - DNA, 2469 bp, Burkholderia thailandensis
atgcaagcgggacccgggtcctcgcatgccgatgatcggcgttcggccgcgcgcgcgatgccatcgaggttgcgggagtcgacgagcagtgaacagagcgaagcgggcgggaaacgttcggggccgcgtggcgccgacgacagtggagcgtgcggcgtgcgctcgggcgggggcggtggacgaggcaatccgtcgatgagccgggcgcagcatgcaccgtcgcgccgtcgcgcgttcgagcgcagcttcgcggcggcggccgcccgcgccgctcacggcgcgcctgccgcgcatggcccgcacgcgtgcctcgccgccgcgtcgcgtcgctcgacggccgtcgagcgctgcgtcaccgcgctcgcgtgcgcggtgacggcgtccggcgcgctcgccgccgacgcggacccggccgaatccgcgcgcgacccgcatcgcgaactgccgaccgtgcgcgtgacgagcgacgcggcgcacgcatcgccgctgtccacgccgctcacggccggctcgcgcctgaagctcgcgagcctcgacatgcccgcgagcgtcgaggcgatcacgtccgggcagatggccgcgcgcggcgatcgcacgatcgtcgacgccgtcacgcgcgcgacgggcttcagcacggccgcggcgcccggcaacggcggcacggcgctcagcgtgcgcggcttcgccggccaggaatcggtgacgacgctcgtcgacggcgtgcgtctctaccccggcgcgggcaccgtcacgttcccgttctcgacgtggtccgccgagcgcatcgaggtgctgcgcgggccggcgtcggtgctgcacggcgaaggggcgatcggcggcgtcgtcgatgtcgtgacccggcgcccgcgccgcgaacgatcgacgacgctgcaggcgagcatcggcacgcaaggcgaaaagcgcgtggcgctcgacacgacgggcgcgctcggcccgcgtctttcttatcgtttccatctgagcgacgagcgcacgcgcggcttcgtcgagcgcggcgacgcgcacgcgacggccgtcggcggcgcgctgaagctcgatgtcgattcgcgtttgtcgattacgctcgattacgactacggccgccagaagccggcgacctatttcggcgtgccggcggcgaacggcgtgctcgaccgcgcgctgcgcgagcgcaactacaacgtcggcgacgcgacgatcgcttaccacgatacctggacgcggcttgccgcgacctatcgcgcgggcaacggcgtgacgctcgacgcccagctctactatctcgcgacgcgccgccattggcgcaacgcggaatcgtacgcgctcgacgcggcggcgcgcaccgtcgcgcgcagcgactatctcgagatcttccatcgcgagcggcagttcggcgagcgcttcaccgcacgcatcgattcgcgcgtgttcggccgcgcgaaccgcctcgtggtcggcgccgagttcaaccagatcgcgttcgacggcgcgaacaacgcgccgtatcgcggcgaatcgaccgtcgccgccgccggcttcgatcccggcgcgttcgcgagccccgatccgacgctgccgcgctttcgcacgcgcacgcatcaggcggcggcgttcatcgagaaccggctcgaggtcctgccgcggctcgcgtgggtgagcgggctgcgttacgaccatctgtcgtttcaccgcgacgatctggtcgcgggcggcgcgttcgacaagacgttcgcgcacaccggctggcgcagcgggctcgtctacgagatcgcgccgggcctgaccgcgtacgcgcaatacacgacgggcgcggagggcgtgggctcgctcgtcacgctgccggcgtcgcaggcgaactacacgctcgcgaccgggcgccaatgggaagcgggcgtcaagcacgagatcgacgacgctcgcgcgtactggacgctcgccgtctacgacatcgtcaagcgcggcctcgtcagcgtcgacccgctgaatccggcgcgcgcgcagcagatcggccgccagtcgtcgcgcggcgtcgaactcgcgggcggcgtgcgtctgccgggcggcgtgacgatcgacgcaaacgcggcgttgctgcgcgcgcgttacgacgcgttcggccagcgcgtcggcgacacggtcgtgcagcgcgcgggcaacgtgccgcacgacatcgcgcggcagaccgcgaacctgtggatcggctgggcgttcgcgccaggctggcgcgcgaatgcgggcttgcgttacgtcggccgtcgctacggcgacgacgcgaaccgcgtgccggtgccgtcgtacacggtgttcgacgcgtcgctcgcgtggcaggcgacgcgcgacgtcggcctcgcgctctacgcgcgcaaccttgcgaaccgtacgtacgcggcgtcgacgtcgaacggcggcgcgcaatggctgctcggcccgtcgcgttcggccgagctcgtcgcgacgctgcgcttctag

SEQ ID NO: 32 - DNA, 2262 bp, Burkholderia thailandensis
atgacaatcaaattcctgcgtcacgcgcaccccgcgcgtgtcgaccgtgcgcgccgtcggcggcgcgcgatcacgctcaccgttcccgcgctcgcggcgggcgcctttcatctcgcgccggccgtcgcgcagacggacgatgccgtgcaccgtcacggcgcactcggcgcgacgagcggcgtcgcgaacgacgcggcacgcggcgcatcgagcgccaaatcgaacgctagggcaaacgaagcgaccgccgtgacgcgcagcgcgacgaaccgcgcgacagccggcgccgcgccggaagcagcgatgctgccgacgatcgagatcgtcgcggcgcccgaatcgacgccgctcgtcgtcgtcaccgatccgaaaacgccgcgccagccgttgcccgcgagcgacggcgccgattatctgaagacgattcccggcttcgcgtcgatccgcagcggcggcacgaacggcgacccggtgctgcgcgggatgttcggctcgcggctgaacatcctcgcgaacggcatgccgacgctcggtgcgtgtcccggccggatggacgcgccgacgtcgtacatcgcgcccgagagctacgacaaggtgacggtcgtcaagggcccgcagaccgtgctgtacgggccgggcgcatcggcgggcacggtgctgttcgaacgcgtgacgccgcgcttcaagacgccgggcatgcgcttcgacggcagtgtcgtcggcggctcgttcgggcgcaacgatcagaacgtcgacgtgacggcaggcacgcccgacttctacgggcgcgtgatcgcgaaccatgcgcattcgcaggattacgaagacggcaacggtcgcacggtgccgtcgcaatgggacaagtggaacgcggacgcggcgctcggctggacccccgacgacaacacgcggctcgagttgacggcgggcacgggcgacggctacgcgcgctacgcgggccgcgggatggacggtgcacatttccggcgcgagacgttcggcctgacgttcgacaagaagcacatcggcgacgtgctcgatcgcatcgaggcgcaggtcttctacaacgaagccgatcacgtgatggacaactacacgttgcggatgcccgatccgacgagcagcatgccgatgcgcatggcctccgaagtgcgccgccgcacgctcggcgcgcgcgtcgcggcgacgctgcgcttcaccgacgcgttcaagctcgtgacgggcgtcgacgcgcagtcgaaccgtctcgattcgcgctccgcgatggggatgcagaactacggtgacaagccgtggaatccgcaggcgaacatgtggaacgcgggcgcgttcggcgagctgacctggtatgcgagcgatgcgtcgcgcgtgatcggcggcgcgcggatcgactatgcggccgcgcgcgacaagcgcgcgacgacgggcggcatgaagatgagcatgcgcaatccgacgttcgacgatctccgctcgcgcgtgctgccgagcggcttcgtgcgctacgagcgcgatctcgcttcgctgcccgtcacgtggtatgcgggcatcggacacgcgcaacgctttcccgattattgggaactgttctcggcgaagcgcggcccgaacggcgccgtcaacgcgttctcggcgatcaagcccgagaagacgacgcagctcgacatcggcgcgcagtacaagagcgacaagctcgacgcgtgggtgtccgcgtacgcgggctacgtgcaggacttcatcctgttcgactacgcgacgggctcgatgggacagacgacgcaggcgacgaacgtcaatgcgcagatcatgggcggcgagctcggcgcgtcgtggcgtccgctcgcgccgtggcgtttcgatgcgtcgctcgcgtatgcgtgggggcgcaacgtgcaaagcggcgcgccgctgccgcagatgccgccgctcgaagcgcgtttcggcgtcgagtacacacgcgggccgtggtcggcgggcgggctgtggcgaatcgttgcgccgcagcatcgctatgcgctgaacgagggcaacgtcgtcggcaaggacttcggtccgagcgccggtttcggcgtgctgtcgctgcacgcgcagtacaacgtgagcaaagcggtgcagatctcggtcggcatcgacaacgtgctcgacaaggcttatgcggagcacctgaacctcgccggcaacgccggtttcggctatccggcgaacatgcccgtcacggaacccggccgcacagcgtgggttcgtttgagcaccaagctctga

SEQ ID NO: 33 - DNA, 2229 bp, Burkholderia thailandensis
tcagaactgcagcgtcgtcagcagcgacacctgccgcgcatcgccgaccgacacgaagaaccggttcacgctcgacgggtaatacgtgcggttgaacaggttcttcacgttcagctggaactgcagcttctgcttgccgacgcgcgtgtcgtaggtcgcgaaagcatcggccgtcgcgtacgcgggcagcgtgaagctgttcgccgaatcgcccggccgcgcgccgacgtagcgccccgccgcgccgatccgcaggtcgtcgccgccgaacacggcgcccgcgtcgtagacggccgcgagcgacgccgtgtgccgcgcgacgttccacagccggttgcccgcgtacagcggatcttcggtcgtcttcgcatcgatgtacgcgtagctcgcgatcacgttccagcgctcgccgatccgccccgacacgtcgagctcgatcccgcgcgagcgcgcgcgtccggacgtgcgccagtcggtctggttcgtcgcgtcgttgtattgcgacacgagcacgttcttcttgtcgatctcgaagaacgcgagcgtgccggcgaagccgctcggcaggtcgagcttcgcgccgagctcccacgacgcgccctgctcgggcgcggtcgagccgtcgatcacgtagccgcccgacatcggcgcgatcttcgacgtcggcttcagcgactgcgtgtagctgccgtacagcgacagcgcgtcgttccacttgtagacgatgcccgcgcgcggcagccacttcgtgccgctcaggttcgtgttgacccggaacggccggccgcgcccggcgagctggctgtagcggacgaagcgcgcgccgccgacgagaatccacttgtcggtcagatggatgctgtcctggaagaacagcgacgcggtgtgcagcgtgtcgctctgatcgctgtcggacgccgatacgctcgtcgacggcgggatcagcccgtacgtcgggttcaggtagctgaacggcgtcttgatcgcctggcgcagcatgtccgcgcggtagacctgccggtattcgctgtcgacgccgaactgcacgtcgtgccgcatcccggcgagcgtcacgcggccgtcgacgtatgcgattgcgtagctgtcggtgctgcgcgagccgtgcgtcgcgtcgttgctgcgcgtgagcgtgcccttgaccggatcgaccgccgtgatgcgtatctggttcgcatcgtaggtctcgcggttgtagctgtagccgaggtgcgccttccagttgggcgcgagctgatggtcgaccgttagttgcaccagattcgattcgccgcgcatgtcgttgaacggctcgtcgaggcggcggcgcgccgggatcgcgagcggctcgttcgtgcgcggatcgagcgcggtgccccgatcgaacggcatcaggaagcgccggtactcgtacgacagcacgacctgcgtgtcgcggccgtaccacgcgagcgacggcgcgacgagcgtctcgcgatgctcgccgtagtcgcgccagtactgctcgttcgtctgatcgacgatcagccggtacgcaagccgcgaatcgccgatcgcgcccgtcgagtcgaacgtgagctcgccgccattcctgccgtgcccgtaggtcgagccgagcaccgagatcgcgttgtggcgcgtgagctgcggctgcttcgtgacgacgttgatcacgccgcccgggtccatgatcccgtacagcagcgaagccggccccttcagcacttcgacgctgtccgtcgtcgcgttcagcgagcggccctgcacgatcggcatcccgttgcgcatcaccgagccgtcgcggttgtcgccgaagccgcgcttcatcaccgtgtcctgcgtgctgccgagcgtgttgccctgcgtgatgccgctcacgttcgcgagcgcgtcgtcgaggttgcgcgggcgctggtcgcgcagcacctgcggcgcaacgatgttgacggcctgcggcacctcggcgagcggcgcgtcgctgcgcagccccgccgcctcgcgcggcgcacggtagctgtccgcgtgcaggccgctcgcgcgcaccgagacggtcggcagcgtcgtgtcggtcgcgagcgccgcccccgcgctcggcgcggccggcccggcgggcgacctgacgagcgtgtagccgccgctcggctgccgcagcgcgacgaggcccgtgcccgtcagcagccggtcgagcgccgcggccgcatccgcgcgaccgtgcaggccggggctttgcaa

SEQ ID NO: 34 - DNA, 786 bp, Burkholderia thailandensis
ttactgcgcggcttgcggtgcgcgcaggtagatctcgacgcggcggttttgcgcgcggccggcttccgtcgcgttgtcggcgatcgggttcgacgcgcccatgccttgcgccgacaggcgggttgccgcgacgccgcgttgcgcgagcgcgttcacgacgctttgcgcgcgattctgcgacagcgtctggttgtgcgcggccgagcccgtgctgtcggtgtagccgacgaccgatgcggtgatctgcgggttctggttcagcgtcgtcgcgaggtcgttcaggagcggcgtgaaggccggcgtgaccgcgtactggtcggtcgcgaacgtgaccgagctcggcacgttcagcttgagcgagccgtccggctgctcggtgacctgcgtgcccgtctgctgcgccgacggcgcgagcttgttcttgatcgcttgccagttgtaacccgtcacgccgccgacgagcgcgccgacgccggcgccgatcgccgcgcccttgccgccgccagccagcgcgccgatgcccgcgccgagtgcggcgcccgtgccggtgccgaccgccgtgttcgtgccttgctgggttgcgcaacccgccagcagggcgccggcgagagcgaaaacggacaagcgcgtcgcgattttggtattcatcttggtttcctctcttgagtgactcgacaagaacaaaaaagaactgctctttcggcgggggcgacccgcgcgccgacgatcatgcaggcgcgcgagcgcctcgatccgtccggcgtcaggtgccggggccgtcttcat

SEQ ID NO: 35 - DNA, 513 bp, Burkholderia thailandensis
ttactgttgatagacgaggtccgcgcggcggttctgcgcccacgacgcttcgtcgtggccgagcgcgaccggcttttccttgccgaggctcacggcttccatctgcgaatccccgacgccgagcagcgacagtgcgcgacgcaccgcttccgcgcgcttctggccgagcgcgaggttgtactcgctcgtgccgcgctcgtcggtgttgccctggatcaggatgtggcgctgcgggtggctcttcaggtattgcgcgtgttgctgcagcagcggctggtactggtcctgcaccgagtagctgtcgaaatcgaagtagacgctgcgcttcgcgagcgggctgttcggatcgttcagcggatcgacggtcacttgcgcgacgttctcgggattcggttgcgtgctgacggcgccgccctggttcgcgtgttcgtcgagcttcacccccgacttgcacgcggcgagcgcgccgatcatcagcatcgcgaacgcgagacgaagttttttcgacatcat

SEQ ID NO: 36 - DNA, 675 bp, Burkholderia thailandensis
ttacttcgccggaacggtcgtcttctgcacttcctgcgtgccgaccacttcgacttccacgcggcggtccggtgcgaggcaagcgatgagctgcttgcggttcttctgcttgcaggtgttgcccgtgatcgggttgcgcttgcccttgccttccgtgtagaccttgttcgccgggacgcccttgctgacgaggtacgacttgacggcttgcgcacggcgcagcgacagacggtcgttgtacttgtccgagccgatgcggtcggtgtagcccgtggccacgaccacttcgacgttcatgccttggatcttcgcggccagttcgtcaagcttctgcttgccggccggcttcaggatggccttgtcgaagtcgaacagcgtatcggcttggtacgtaatcttctggctcgtgatggccggagcaaccggtgcgaccggtgccggggccggtgcttgggcgaccagcgcgccgtcgcacttcgcgttggcggtggccggcgtccagaacgcatcgcgccagcagagctcgttcgtgccgttcatccacacccattcgcccgtgccattcacccagttgtcattcacggcttgtcgcgacgccggcaccgactgtgccgaagcggatgcagccataactgcggtagctgcaatgaacgcgagctttgaaagtttattcat

SEQ ID NO: 37 - DNA, 1140 bp, Burkholderia thailandensis
ttagaagcgatgacgcaggcctgccgtgacggcgatctgcttctcgctcgacgacatgccgccgacgccgttgatataggcgccgaggcccgtgccgtcgctgttgaccttctgatacacgccttgcaggtacacgtccgtgcgcttcgacagcgcgtaggccgtttgcaggttgaactgattccagcccgggtggtggttctcgatgaagccggcggtgtacgtgtacgagcccgcgaccgtccatgccggcgtgatcgcgtagcgcgcgttcacttcgtagttgttgaaacgcatgaacgtgccgtcgagcgcgatgccgctcgacacgcccgatgcgcccgagctgatcgccgtcgcgcgattgacgcgcgattgcgtgaacacgaagccggccgtcgccgggccgtacgtgtaattcaggccgccgccgaacacgcgctggcgcttgccgacgaacgtattgtcgagcgcgaccgcgcccgaagcgttcgacacggtcgggccgaagtcgttgttcaactgcaggtagccggcgccgacgttgaagccggcgtagctatacgacacgcccgcgctatacgcacggttgttcgcgaactcgttgctgttcgagaagccgtacaacgcgccgaacttcaggccggcccagttcacgctcgtgtacttgaccgcgttgttgatccggaacgagttgttcaggttgtcgttgtcgaacgggtgggcaaactgcacgccgccgaattgcgtgccggtcagcgacagcggcccgatgtagtcgacgacgctatcgtactgacggccgagcgtcagggagccgtattgatcgtgcgacagaccgacgaacgcctggcggccgaactcgcggccgttctgcttgagcgtgccgttattgatgccgaagccgttttccaacacaaaaatcgccttcaggccgccgccgaggtcttcggcgccgcgcaggccccagcggctgccgttgaccgagccgctggactgcgaccatgcactgtggccgccttggttgttcgtgtaggtgatgccggcgtcgatgaggccgtacagcgtcacgctgctttgcgcgtgagcggccgtcgcgaagacgccagagagagcagcgacgatgagggtctttttcat

SEQ ID NO: 38 - DNA, 1245 bp, Burkholderia thailandensis
tcagaacttgtgacggatcgccgcgcggaccgcgaactggttcgccgatgccgacgggccgtccgtgccgacgacgtagccgccatccgcgatcgtgcccgtcttgtcgcccgcaaccttctggtatgcgccctgcagatagacgtcggtgcgcttcgacaggttgtagtccgccatcaggccgatcgtgtggtacttcggcttgaccgtgcccgcagccgcgtcgaacttgccgtccgtgtacacatactgcgcgccgatgaagagcgccggcgtcagttggtacttgccgttgatttcgaagttctggaacttcgtcgcggtcagaccgaggcccgcgaacgtcgccgtcggcagatagaccgtcgagaccgggttcttcacgtcggtcttcgtgtagacgaagccgaccgtcgccgggccgaacgtgtagttgacgccgccgccgaagatgcgcaggcggtcggccgtgaagttcgcgtcgttgtcggcgatcgcgccgcccgccgtcttgcccgggttgttcgcctgcaggtacgcggccgcgagttgcaggccgcccagcgtgtacgcggcgccgatgctgtattgacggttgttcgagaagcccgtcgcgttgctgaagctgtacgtgccgccgacttgcagaccgttccagtccgggctcgcgtacttgatcgtgttgttcacacggaacgagttatccgtgttgtcgttgtcgaacgggtgcgagaacagcaggccgccccagttgccgttcgccgtcagcggcgcgaggtagtcgacgaccgaatcgtactggcggccgagcgtgagcgaaccgtattgcgcgtgcgacaggccgacgaacgcctggcggccgaacatccggccgccctggccaagccggccgttattcacgtcgaagccattttccaacgtgaagacggccttcaggccgccgcccaggtcttccgagccgcgcaggccccagcggctgccctgcgcgaagccgctcgcgagctggtagttgctcttgccgacgccgttgacgttcacgttgctcgtgtagttgaaaccctcgtcgatcacgccgtacagcgtgacgctgctttgggcgaaaaccggcgcggcgaatgcgagcaatgcggcagcggaaatgatgtgctttttcattatcgatatctccagaccttgattcggcggcctcgcggatgtcgggccgccacgatgtgttcggcgtttctgcgccccattccggggcat

SEQ ID NO: 39 - DNA, 1125 bp, Burkholderia thailandensis
ttagaagcggtgacgcagaccaaccgtcgctgcggtttggttgatcgacgtgctgaacggcgtgctgaggtcgccgttgtagatcgacgcattcgcgttcttcgacgaacgctggtacacagcttgcgcgtacacgtcggtgcgcttcgacagcgcgtagtcggcttggacgccaacttggttccagtgcgcgctttcgccgttcgccttcgcgttcgtgtacgtgtaagcaacgcccagacccagtgccggcgtcaggttgtacttcacgttcgcttcgtagttgtcggcacggatggtcggcgcgccgtttgccaggttgtcgagacgcgattgcgtccagagcaggccgccttgcagcgggccgtaagcgtagcttgcgccagcgccgtacacgcgcgaacggccttggatgcttgctgcgttcgtgccgccgatgttgaagccggtcagcggatccgttgcgcccgtggtgttcgcgcctgcgttgttagcttgcgagtacgcggcaccgaccttcaggccttggaactggtacgaagcgcccgcgctgtacgcacggttgttcgcgaattgcgagttgttcgagaacgagtacgtgccgccgaattgcaggccggcgtagttcgcgctcgtgaacttgaccgtgttgttcaccgcgacgtcgccgttcgtgttcaggcggtcgttgttgagcgggtgcgcgaagtacgtgccaccccaggtgcccgttgccgacagcggcgacaggtagtcttgggtcgcgtcgtactgacggcccagcgtgacggtgccgtagttgctcgacaggccgacgaacgcttgacggttgaacatgccgccaccgttgttgaagcggccgttaccgatgttgaagccgctttccaacgtgaagatcgccttcaggccgccgcccaggtcttccgaaccgcgcaaaccgaaacggctttggtcgacgccggcgccgaccgaccacagcgacttacccgagcccgacggcgtcgcgacgttgctttggtacgtgatgcccgcgtcgagcacgccgtacagcgtgacgctgctttgcgcgtgtgcgacggtagcgaacgatgcagcaactgctgcaacaatcagagtcttgttcat

SEQ ID NO: 40 - DNA, 1572 bp, Burkholderia thailandensis
ttagaacttgtggcgcaggcccagggcaaccatctcttgcgacttcgtaccgccgatgccgtacgagccgatcgacgcctgtgcgtcgccgccgcccgcttgcgtgccgcttgcgtgctggtacgcgccagccagatagacgtcagtccgcttcgacagcgagtagtctgcgcccagcgaaacctggtggtacttcgcgttcgaatcgccgctcgacttcgtgtagatataaccgaggcccagcagcagcgccgacgtcgcctggtacgtgacgaagccgcggcccgtgttgtacttctcggtcgagccaaatgccgatgcgctgtccgacttgtattgcgcgttgctgtagccgaggccgaacgtgaacgggccaaacacatattgagcgccgacttgagcgatgccgatcgacttggccgtcgcgtagccgttgttcatgaacagcgagttgtccgggccatcgaagatcgcgtcggaggagccgccccagcccgtgcgaacgcctgctgcgctaagcggagccgagttcgatgcgtggaagtagccggccccgatgccgaccgggccgttgttgtacgccgcggcggccgcccacgtctgtccggtacccggcgagcctgcgatgccgctgaagccgtacaacgcctcgaactggaagccggcaaacacgggcgacgtgtacttgaccgtattgttcacgcgcaggctgttgtcgttgttgtcgacgtcacccggggtggcgaacaggctgccgaagtagttgtctgcagtgacgggctgaaccaggtcgacgagcggatcgtattgacggccgagcgtcagcgtgccgtacgtatcgctttgcacgccgacgaacgcctgacggccgaacatgcggctgccttggccgagcgcgccgttagccgaattgaagccgttctcgagctggaaaatggctttcaggccgccgccgagatcctcggtgcccttcaggccccagcgggcaccttgcaggttgccgctgcccatttgccatgcgttgttggccttgccgtcgttaccatggacataagtgatcgacgtatcaatcacgccatacagcgtgacgctgctttgagcctgagctgcaccggccgcgcccagcagcgcgagcgagagggtagacagagcgagtttcttcattgagctatttctccacgcgagtgagtcgttatttgttgcggattggagaatagcgcactgcatcaaatgcaagaaatccaaaaaaataaagtgtctcaaaaaggtgacagcgatgaaaagtctttttatatcaatcacataaacgaccatttcgattccgggaacactggccgatggttgcgttgcgattgttgcggaagcaagcatattgcttgtgtgtggggccgttttcgggctgttttcgcagcaaagtcggtgcatgcaaacgtttgcgggcgtggcggtggctgcgatggcgacaggcgcgcgctcgaacgccgcactctgctccgacacgacgccggcatctttccgcgccaggtgcgcggtagatcgagcaggacgtttgctcgggcgcaatacgcgcaa

SEQ ID NO: 41 - DNA, 1635 bp, Burkholderia thailandensis
tcacgcacacgcgtcttcgccgccgcacgcggcgcgcgaccagccgccgccgagcgcgcgatacagcgtgatggcgttcgtgagccgcaactgcttcaggcgaatcagttcctgcccggactcgaacgtgctgcgctgcgcgtcgagcaattcgagatagcttgcgacgccgctgccgtagcgccgctccgcgagccgcagccgctcggcgtccgcgccgtagaccgcctgctgcgcggcgagctgcgcatcgatctgatcgcgcgcggcgagcgcgtcggccacttcgcggaacgccgtctggatcgtcttttcgtattcggcgaccgcgatatgcttgcgcgcgtcggcgacatcgagattcgcgcgattgcgtccgcccgcgaagatcggcagcgtgagccgcggcgcgaacgtccacacgctcgagcctgccgagaagagccccgagaacgcgtcgctcaccgagccgatgtcggtcgtgagcgcgatgcgcgggaagaacgccgcgcgcgccgcgccgatgttcgcgttcgccgcgacgagccgctgctcggcctgccggatgtcaggccgctgctcgagcaggtccgacgacagccccggcgacacccgcgcgaccgcgagttcgtcgagcgcgggcgcatcggcgggcagggccgccgtgaagtcgcccgcgagcagcttcagcgcgctcgccgcctgcgtgtgctcgcgctcgagcgccgccttcgatgcgcgcgcggacgcgacgagcatctcggccgtgcgcagctcgatcgccgtgctcgtgcccgccgcgtagcggcgctgcgtgagcgcgtaagtcgcgtcgcgcgcggcgagcgtgcgttcggcgagcttcagttggtcgacgagcgcgcgctcgcgcacataggcggacgcgacttcggcgatcaggctgacgcgcgccgcgcgctgcgcctcggcggtcgcgaagtactcggcgagcgccgcgtccgacaggctcttcacgcggccgaacaggtcgatctcgaacgcgctcaagccgacgctcgcgcgatacagcgagctcgtcgcgctctcgcgcagcaccgggtcgtagagccgcgtgcgctcgtagccgaggctgccgtcgatcgacggcagccggtccgcgcgcgcgacgccgtaaaggccgcgtgcctcctcgatgcgcagcgtcgcgatccgcagatcgcgattgttcgcgagcgccgcgtcgatcagcgcgcgcagcgccggatcggtgaagtacgcgcgccagtcgtcgaggcgcacatcgtgcatctcctgcacattgccgccgccgcgcgcgtcggacgctggctgcgcgtcgcgcgcgccgctgccggctgccgccgggctcgcggcgcgcggcgcgcccgccgccgcgggcagataattcgccggcacgggcgcggccggacgctcgtagcgcggcgcgagcgtgcagcccgtgacgagcgcggccgcgagggcggccggccatgcccgcagcccgcccggccgccgcgaaccgtgcggcccgccctgacgggccaggggtttcatcatcgttttcacttgatctccagtgccgcgcgcgcgccgccgcggcgacgcggaacgatgtcgaccacgcggccgacgcat

SEQ ID NO: 42 - DNA, 1560 bp, Burkholderia thailandensis
atgaagcgaaaacatgctttgactgcactcgcagtcgcgctgctcgccgcgggctgcacgctcgcgccgcgctacgagcgtccggccgcgcccgtgtcgggcgcgttcccgaccgacggcgtctacgccgcgcagccgggcgccgcggccggcgcgcgcagcgcgaacggccaggcggccgtcgacatcggctggcgcgagttcttcgtcgatccgcgcctgcagcggctgatcgagatcgcgctgaagaacaaccgcgatctgcgcgtgtcggtgctcaacgtcgaggcgtcgcgcgcgcagtatcggatcacgcgcgcgggcctgttcccgacgctcgacggcaccggcacgggcacgatccagcgcacgccggccggtgtgtcggtaaccggccagccgctcatctcgcggacctacaatgtcggcgtgtccgcgtcgtgggagctcgacctgttcggccgcgtgcagagcctgaaggatcaggcgctcgcgcaatacttcgcgaccgcgcaggcgcgcaaggccgcggagatctcgctcgtcgcgagcgtcgccgatcagtatctgacgctgctgtcgaccgacgatctgctgcagatcacggagaacacgctgaagacggcgcgcgcgtcgtacgacctgacgaagctgcagttcgacaacggcaccggctcggagctcgatctgcggcaggcgcagacggtcgtcgagaccgcgctcgcgaaccagcaggcgcaggcgcgcgcccgcgcgcaggcggtcaacgcgctcgtgctgctgatcggcgagccgctgcccgacgatctgccggccggcctgccgctcaatgcgcagaatctgctgaccgacatcccggccgggctgccgtccgatctgctgacgcgccgccccgacatcatgcaggccgaggagacgctgcgcgcggcgaacgcgaacatcggcgcggcgcgtgcggcgttcttcccgaaaatctcgctcaccggcgcgttcggcaccgcgagcccgacgctcggcggcctgttcaaggcgggcacggcggcgtggtcgttcgcgccgagcatcgcgctgccgatcttcgagggcggacagaacatcgccaatctcgatctcgcgcacgtgcagaagcgcatcgagatcgcgaactacgagaaggcgatccagagcgcgttccgcgaggtgtcggacgggcttgccgcgcgcggcacgtacgatcagcagatcgcggcgctcgagcgcaacgagcacgcgcagcagcgccgctacgatctgtcggacctgcgctacaagaacggcgtcgacagttatctgtcggtgctgaccgcgcagacggatctgtattcggcgcagcagcaactgatcagcgcgcggctcgcgcgctggacgaacctcgtcgatctgtatcgcgcgctgggcggcggctggatcgaacgcgcgggcgagacgccgcgcccggcggatgcgcctgtcgactacggcaaggcggcagcgcctgcgccggcgtcggcgtcggcgtcggcggcgcccgctgcggcggccagcgcgccggcggccggctga

SEQ ID NO: 43 - DNA, 675 bp, Burkholderia thailandensis
gtggcaagcgaagatcggcaagattccggtcgcgagcgcgtaaataggaatgattttcaggccggatttcaatccggcctttttgatgcggcgaacccgttccacctttcggatatcgaacggattcgcccttggcttttcgcgaacgagcgtttatcgttcaggaactcaagcccccacacgtcacaaggaacgaacatgcaaggcgacaagaaagtcatcgaatatctgaacgcgcagttgaaaaacgagctgaccgcgatcaatcaatatttcctgcatgcgcggatgtacaagcactggggtctcgagaaactcggcaagcacgaatacgacgaatcgatcggcgaaatgaagcatgcggactggctgatcgaacgcgtgttcatgctcgacggcctgccgaacctgcaggatctgcacaagctgctcatcggcgaggaaaccgaggaaatcctgaaatgcgatctgaagctcgaacaggtctcgcaggcgacgtgcaaggaagccatcgcgtattgcgaatcggtgcgtgattacgtgtcgcgcgaaatcttcgagaaaatcctcgacgacaccgaagagcatatcgactggctcgaaacgcaaatcgacctgatcggcaaggtcggcattcagaactatcagcagtcgatgatgggttcgccggagtaa

SEQ ID NO: 44 - DNA, 240 bp, Burkholderia thailandensis
atgatcgtctgcgtgtgcaagtccgtttccgatcggaagattcgcgcatccctcgcggaaggcgtgaacaccttcgaagaactccagttcgaactcggggtcgccacctgctgcggcaagtgcgaggaaaccgtgcgcgagatcatggcggaacagggcgtttgtgcgagccgctgcggtgtcgagccccccgcggccgtgccggtccccgtcacgttctacgaacgcaaggcggcctga

SEQ ID NO: 45 - DNA, 984 bp, Burkholderia thailandensis
gtggggcgcatcgggtaccggcggcgcgcggctcgttcgcgcgccgcatcgagaggcaagcgcatgctgaatttcctggtcaaacgactgttcgggctgctgccgacgctcgcgtgcgtcgcggtgctcgtgttcctgttcgtccacctgctgccgggcgatcccgcgcggctcgcggccgggcccgaagccgacgacgcgacggtcgcgctcgtgcgcgccgatctcggcctcgacaagccgctgcccgcgcagttcgcgagcttcttcgcgcggatcgcgcaaggcgacttcggcgtctcgacgcgcagcaagcggcccgtcgcgaccgagatcggcgagcgcttcatgccgacgctgtcgctgaccgtcgtcagcatggcctgggcgacgctcttcgggatggcgatcggcatcgcgtcggccgtgtggcgcaaccgctggccggaccgcgtcggcatgacgctcgcggtgtcgggcatctcgtttccggcgttcgcgctcggcatgctgctgatggaagtgttctcggtgaagctcggctggctgcccgtcgtgccggacggctcgtggaagagctacgtgctgccgtcgctgacgctcggcgcggccgtggccgccgtgatggcgcgcttcacgcgcgcttcgttcatcgaggtgctgaacgaggatttcgtgcgcaccgcgcgcgcgaagggcgtgcgcgagccgatggtcgtgctcaagcactgcctgcgcaacgcgatgattccggtcgtcacgatgatggggctgcagttcggcttcctgctcggcggctcgatcgtcgtcgaggcggtgttcaactggccggggctcggccgcctgctcgtcgatgcggtgacgatgcgcgactacccggtgatccaggcgatcgtgctgctgttctcgctcgaattcatcctgatcaatctgaccgtcgacgtgctgtacgcggtcatcaacccgacgatccgtttcaagtga

SEQ ID NO: 46 - DNA, 1203 bp, Burkholderia thailandensis
tcagaagcgatggatcagaccgacgccgacgcccacctggctgcgcgacgacgacggcgacgtgttgaagccgtcgccgatcgacgcggtcgcgtcgatgatcttgccgcccgcgagcgtcttgccgttcgcacgctggtacgcctcgaccgcgtaaaggcccgtgcgcttcgacaggctgtaatactgcgacagcgtgaactggtggtactgcgccgcgctcgtgatgccgttcgattgcgtcgcgcgcgtgtacgcgtagccgcccgcgaagtcccactgagcggacggcttgaagtgcagcaccgcacccgccgtgttgaagatcgcggtgttgcggaacgccgagttgacgcccggaatgtactgcacgttcgagtacgacaccgagatgtcccacgcggacgagaactggtagccggccgtgaccgcgacgcgctgctgcgcctgcgcggtcttgtagccgttgttgatcgccgacacggccgtctgcgcgccgccgttggacgtcgtcgaattcgcgccccagtcgccgccgcccgacgtcgagttgttcacgcgctggaacgccgccgcgatgccgagcggaccgttcatgtactggatgcccgcgctccacgtggagccggcgttcacgctgcccggctggccgccgaacgcatacgagccgccgaacgtgaagccgtagaacttcggcgacatgtagacgagcgagttgttcgtgcggtagctggtgtcgagcgagtcgatgtcgcccgggtgcgcgccgaagtaaccggtgagccaggtcgtcgggctgtacggcgacagcagcgtgtagtacgcggtgtattgacggccggccgtcagcgtaccgtacgtcggattggtcaggccgacccacgcctgccgcgtgaagatgccgcccgcgaactgcgacgtgccgttggccgtgctgaaacccgattcgagctggaagatcgccttcgagccgccgccgaggtcctcgctgcccttcaggccgaagcggctgcccgcccacacgcccgtcgacatcttcaccgccgagcggccgcccgtcgttgagccgagcgacgtgctgctgctctgatacgcgatgccgttatcgacgataccgtaaagcgtcacgctgctctgagcgtgcgcggtggcgacagccgccaatccggcggccgtcatcgcgaccgctgtgcgctttttcat

SEQ ID NO: 47 - DNA, 1584 bp, Burkholderia thailandensis
ttgccacaacaagtaattcagacagataaatgtaaggaaatccttgcagtgtccattattcattccgagtcaggaaacacagcgatgaaaaccttcccgttgtccgcttgccgaaccgccacggccgtcgcggtcgccgtgctcgcgctcgcgggatgcgcgaactatttcggcatcaagagcgacaaggcgatcgcgcccgcgacgcagttcgagagcgcgcagagcctgccggcgcaaggcggccggtggccgtcgctcgactgggcgaaccagttcggcgatccgcaactgcccaagctgatcgacgaggcgctcgaaggcaatccgacgatcgcgcaagcgcaggcgcgcatcgcgaaggcatcgtcgtacatcgaatcgtcgcgctcgacgctgctgccgaaggcggacgcgaagtactcgtggacccgcgagctgtattcgagcaacgccctcgtcccgccgcccttcggcggtcagtggtacagcgagaacaacgcgctcgcgagcgcgtcgtgggaactcgacctgtggggcaagaaccgcgcgcgcctcaatgcggccgtgtcgcaggaaaaggccgccgaagccgacatgcagcaggcgcgcgtgacgctcgcgacgtcggtcgcgcgcacgtacaaccagctcgcgcagttgtacgcgctgcgcgacatcgccgagcgcgagatctcgaaccggcagacggtcggcaagatcaccgacggccgcgtcggcgcgggcctcgacacgaacgtcgagcgccagaccgcgctcggcaacatcgcgacgagccagtcgacgctgtccgatctcgacggccagatcacgaacgtccgctatcagctcgccgcgctgctcggcaagggcccggaccgcgggctgcagattgccgcgccggtgctgagcccgggcggcggggtcgcgctgccggacaacctgcccgccgatctcgtatcgcgccgcccggacctcgtcgccgcgcgctggcaagtcgaggcggcgatgcacgacgtgaaggaagcgaaggccgagttcttcccggacatcaatcttgcggcgggcctcggcttcgacgcgttcggctggggccgcttcctgaacttcgcgagccgccaggcgcaattcggcccggcgatccatctgccgatcttcgacggcggcgcgctgcgcgcgcaactgaagggccgctacgcggacttcgatctgtcggtcgcgaactacaaccagacgctcgtgagcgcgctgaacgacgtcgcgacgcaagtcgcgtcgatccgctcgatcgacacgcagatgggcgacgcgcagcgcgcgctcgatgcgtcgacgcgcgcgtacgagctcgcggtgatccgctacaaggcgggcctgtcgccgcagctgcaggtgctgaacgcggacagcaaccggctcgccgccgagcagacggtgacgaacctgaagatgcgccgccgcgatctgcagatcggtctcgtgaaggcgctcggcggcggcttcgacgcgaccggcacgcggctcgccacgcccgcaccggcagtggcggcggccgccgcacccgcgcggcacgcgtcgaactga

SEQ ID NO: 48 - DNA, 2337 bp, Burkholderia thailandensis
atgtcccatgaacttgccgcgcacgtcgcgcgcacgcggctcgcggccgcctgcgtcgcggcgttcgcctggcccgccgcgcacgccgtcacgacgggcgccgccgtccctgccgattcaacgtccgccgccgctgccgagacgaccgcatccgggaaaaccctggatatcgtcagggtgaccgcgcagcgccccgcattcgcgtccgacacgcccggcgtcgtcgaggcgctcacgcgcgagcagatcgattcgcacgtcaacgtgacgaccgaagacgcgctcaagtacgcgccgaacctgatggtgcgccggcgctatatcggcgatcgcaactccgtgttcgccggccgcgatttcaacgagttgcagagcgcgcgcggactcgtttacgcggacggcatcctcctgtcgaatctgctcggctccagttactcgtatccgccgcgttggtcgctgatccagcccgacgacatcgcgcgcgtcgacgtgctgtacggcccgttctccgcgctctacccgggcaatgcgatcggctcgaccgtgcagatcacgacgcgcaagccggatcggctcgaggcgtcggtgtcgacgcagttcttcacgcagcgctatcgcgacggctacggctttgccgacagcttcggcggcaatcaccagaccgcgcgcgtcgccgaccgcgtcgggcgcttctggtatgcgctgtcgctcgaccggctcgagaacgacagccagccgatgcaatacgcgagcccgaatggcacgttcgatccgcggctcggcgcgagcgtgccggtgacgggcgccgtttccgacatcggcccgaacggccggcctcggacgatcgtcggcgcgcagacgatcgagcgcaccgagcagctcaacgagacgctgcgcttcggctatgcgttcaccgaccacgtcgatgcgacggttacgctcggccactgggagaatcactaccggcagcacggcgacacgttcctgcgcgacgcggcgggcaacccggtatacggcggcaacgtgtcgttcggcgggcgcagctacacggtgtcgccgaccgcgttcgcgccgcagaccggcgaccaggagaactggctgtacgggctcgggctcgacgcgcgtctcgcatcaggctggaagctgtcggcgaccgcgtccgcgtacgaggtgtcgcgcgacgtgctgcgcagcgcgtccggcgcgccgaccggcgcgtgggacggcggcccgggcacggtattccatggcgacggcaccggctggcgcaccgtcgatttgcgagcggagtcgcccgacgtgcgcgggcaccgcttctcgttcggctatcacttcgacacctatttcctgcgcaacgcgacctacaacacggcggactggcaaaacgccgtgccgacgacgcttgcgaaccgttatcgcggcaacacgcgcacgcaggcgctgtacgcgcaagacgcgtggcgtttcgcgcccggctggctcgcgacgctcggcctgcgctacgaacgatgggatgcatacggcggccagctcggcaacgcgaacgcgacgctcggctacgccggccgtggcgcgaccgcgctgtcgccgaagctcgcgctcgaatggcagccaacggacgcatggcgcctgcggctgtcgttcgcgacgggcacgcgctttccgaccgtggccgaactgttccagggcacgatctcgaacaacgcgatcgtcaacaacaacccgaacctgcaaccggaaaaggcgatcgactgggacttcacggccgagcgcgacgtcggcttcggcgtcgtgcgcacgagcgtgttccagagcgatctgcgcaattcgatctacagccagacgacggtcgcgggcgcttcgacgtacacgaacatctcgaacgtcgaccgcgtgcgggtgcgcggcgtcgaactcgcgttttcagggcaggacgtcgcgatcaaggggctcgacgttgacgcgaacgtgtccgcgacgaatgcgcagacgctcgccgatgcggcgaatccgaactacgtcggcgcgcgttggccgcggattccacggatgcgcgcgaacttgctcgcgtcgtaccgcttcggcgagcactggatgacgagcgtcggcgtgcgctattcggggcggcagtacaacgcgctcgacaacagcgacgtgaacccgaacgtgtacggcggcaccagttcgtttgcggtcgtcgacctcaaggcgcgctaccggttcgatcggcactggctcgcgtcgttcggcatcgacaacgtgaccgatcgccgctactacgtgtttcacccttatccaggccgcactttttatggagagttgaaatggtcgctgtga

SEQ ID NO: 49 - DNA, 2178 bp, Burkholderia thailandensis
ttgatacgttatatcgtttcgttgtcggcgcgcgattcggcccgtgattccgtccaccccgagaacaccgcaccgattaccgcaatggatcaccaccgacgtatcgcgccgccttccgcccgcaggctgcatcccttgtcgttgctgctcgccgcgagccttgcgcacggcgagacgggcgagccagccggccgcccgtcgagcgcgccgccagcgacggcgctcgcgccgatcttcgtgaccgcgaacccgctcggcgcatcggcgctcacgtcgccgacggcgtcgctgtccggcgacgcgttgacgctgcgccgcgccgattcgctcggcgatatgctgaacggcttgcccggcgtgtcgacgacgacctacggtccgctcgtcggccgcccgatcatccgcgggatggacggcgaccgcatccggcttttgcagaacggcgtcgccgcatacgacgcatcgtcgctgtcgtacgatcacgcggtgccgcaggacccgctgagcgtcgagcgcgtcgagatcgtgcgcgggccggccgcgctgctgtacggcggcaatgcggtcggcggcgtcgtcaacacgatcgacaaccggattccgcgcgaagcggtcacgggcgtcacgggtgcgctcgacgcgagctacggcggcgcgaacaacgcgcgcgcgggggcggcgctcgtggaaggcggcaacggccgcttcgcgttccatctcgacgcgttcggccgcgagaccgacgagttgcgcatacccggctatgcgcactcggcgcgccagcgcgcgcgcgacggcgaggacgcgagcgagccgtacggcaagctgccgaacagcgacggccgccgttacggcggcgcggcgggcggctcgtacacgtgggccgacggctacgtcggcgcgtcgtacagcggctacgaatcgaactacggctcggtcgccgaaaccgatgcgcggctgcggatgcggcaggagcgcgtcgcgatcgcgtcggaggcgcgcaatctgcgcgggccgttctcgcagctgaaattcgacttcggctacacgaactatctgcaccgggaaatcgaggacggcgtgaccggcacgacgtttcgcaaccacggctacgaggcgcgcgtcgaggcgcgccaccgcaagctcggcccgttcgaaggcgcgctgggcgtgcaggtcggccagaacacgttttccgcgcttggcggcgaggcgctcgcgccgacgacgcgcacgacgagcgtcgcattgttcggcctcgaggaatggcaggcgaccgatgcactgaagctgtccgccggcgctcggatcgagcacgtgcggctcgacccgagcgcgaacggggacgataagtttggcgtcgcgcgctcacgcgatttcaatgcgggcagcgtgtcggcgggcgcgctgtaccagctcgcgcccgcgtggtcggtcgcgggcaacgtgtcgtacacggagcgcgcgccgacgttctacgaactgtacgcgaacggtccgcacggcgcgacggggcaatacctgatcggcctgccggatgcgcggaaggagaaggcggtgtcgaccgatctcgcgctgcgctacgcgaacgggccgaaccgcggcagcgtcggcgtgttctacagccgcttgcggaactacctcgccgaatacgacaccgggcggctcgtcgacgacgaaggcgcgcccgtggccccggggggcgacgagacgctgcgcgaggccgtctatcgcggcgtgcgcgcggagttctacggcgtcgagctcgagggcaagtggcgcgcgttcgagaagcgcgggcatcgcatcgatctggagctgggcgccgactacacgcatgcgcgcaacgcggacacgggcgagccgctgccgcggatcgcgccgctgcgcgcgacgctcgcggccgattacggctacggtccgttcggcgcgcgcgcgcagctcacgcatgcgtgggcgcagcatcgcgtgccggaaaacgatctggcgaccgacggctatacgtcgctcggcgtcgtgctgacgtacaagttccgcgtcggcgcgacgaactggctcgcgtacctgcgcggcgacaacctgaccaaccaggatatccgctatgcgagctcagtcgtgcgcaacatcgcgccgcagggcgggcgcagcgtgacggtcggcatgcgcacgacgttctga

SEQ ID NO: 50 - DNA, 1263 bp, Burkholderia thailandensis
atgcgcgtcgaacgggttccataccgcttaatcactgtcgcgacggctgccgtttttctggccgcgtgcggaaaaaaagaatcggctccgccccctcaaacgcccgaagtcggcgtcgtcaccgtccagccgcaagccgtgccggtcgtctccgaattgccgggccgcacgagcgcgtatctggtcgcgcaggtgcgcgcgcgggtggacggcatcgtgttgcggcgtgagttcacggaaggcagcgacgtcaaggccggccagcgtctgtacaagatcgatcccgccccgtacatcgcgcagttgaacagcgcgaaggcgacgctcgcgaaggcgcaggcgaatctcgcgacgcagaacgcgctcgtcgcgcgctacaaggtgctcgtcgccgcgaacgcggtcagcaagcaggactacgacaacgcggtggccacgcaagggcaggccgccgccgacgtggcggccggcaaggccgcggtcgacaccgcgcagatcaacctcggctatacggacgtggtctcgccgatcacgggccgcgtcggcatctcgcaggtcacgccgggcgcgtacgtgcaggcgagccaggcgacgctgatgtcgaccgtccagcagctcgatcccgtctacgtcgacctcacgcagtcgagcctcgacggcctgaagctgcgccaggacatccagagcgggcgcatcaagacggagggtccgggcgcggcgaaggtcacgctgatcctcgaggacggcaaggcgtactcggagccgggcaagctgcagttcagcgacgtcacggtcgaccagacgacgggctcggtcacgattcgcgcgatcttccccaacaagcagcgcgtgctgctgccgggcatgttcgtgcgcgcgcgcatcgaagagggcgtcaacgacaacgcgttcctcgtcccgcagatcggcgtcacgcgcgatccgaagggccaggcggtcgcgatgatcgtcgacggcaagggcaaggtcgagccgcgcgtgctcacgacgagcggcacgcagggccagaactgggtcgtcgaaggcggcctgcaggcgggcgaccgcgtgatcgtgcagggcatcgacaaggtgcgcccgggcatgaccgtgaagaccgccgaagctcaattgccggccgcggcgtccggcgcgtccggcgccgcgcccgcgggcggctcgcccgcccaggccgcggcggcgagcgcggccgcatcgggtgccgcgccgtcgagcgctgccgccgcgtcgagcgcgaaataa

SEQ ID NO: 51 - protein, 754 aa, Burkholderia pseudomallei
MMKVRPSRPLCNLEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNAYPRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAADNSLTVPSYTLFDAALHYELRNWRFALNATNLFNRRYVAGCQSDAVCMYGNQRTVIATAKYNW

SEQ ID NO: 52 - protein, 510 aa, Burkholderia pseudomallei
MNKTNINERIARVAKIAAASGLLVALLAACAVGPDYRRPDVATPAAFKEAPALAPGEQAGTWKAAEPADAAHRGEWWRVFGDPVLDALETQALAANQNLKAAAARVEQARAATRAARSQWFPQVGVGFGPTREGLSSASQFQPQGSGPTNATLWRAQGTVSYEADLFGRVGRNVEASRADEAQSQALFRSVQLALQADVAQNYFELRRLDSDQDLYRRTVGLREEALKLVQRRFAEGDISELDVSRAKNELATAQADAVGVARRRAASEHALAILLGKAPADFSFSETPIAPVVVRVPAGLPSALLERRPDIAAAERAMMAANARIGLAKSAYFPKLDITGAFGYEAATLGNLFLWSSRTFLLGPFAGTALTLPIFDGGRRSAGVAQARAKYDEEVANYRQQVLVAFREVEDNLADLRLLDDQIRAQSDAVNASRRAAKLSRTQYQEGAVSYLDVIDSERSVLESQLQSNQLTGTQAVSTVNLIRALGGGWGSDAALGSREPGKQDVATR

SEQ ID NO: 53 - protein, 748 aa, Burkholderia pseudomallei
MKSRSDELKLGKFTTLCSVLAASPAFAQDAAPPAASADHDKELAPIQIKGAAEHSYKADFSSSVKFTAPLVDTPKSVTVIPQELIHNSGAATLTEALRTVPGITFGAGEGGNPLGDRPFIRGYDTQGSMFVDGMRDTGATTREIFNTERIEITKGSDGAYGGRGGAGGSINLVTKAPHLGTTAEASAGLGTDRYRRFTADGNWQFADHAAFRLNLMSHNNDVAGRDAVNNERWGVAPSIAFGLGTPTRVSASYYHLSTDDLPDGGIPYFYTTANKPANVDTIYPANVDRHNFYGLVNRDFRKTTTDIGTLRIEHDITPSLTVRNTTRYTESTQDYIWTQPDDSQGNVVNGRVWRRNNNRNSAINSIANQTELFGEFRTGPFKHSFTTGIELSREWGKRDSYSVATGTGKICQQGIGAASGYNCTSLGSPNPNDPWAGSITRNNDYAHARTVTKSLYGFDTVELSKHWQVNAGVRVDDYSTRFTDTRANGGKTYTRDDTLVNWQLGLVFKPARNGSVYASYATSSTPAGALLGEGSETQSLTPGRGGVGANADQLAPEKNRSIELGTKWNVLDDKLSLTAALFQIDTTNARVTLPNNQYAMVGNKRVQGLELGFAGQLTRAWQVFGGYTYMKSELRDNGRNTADNGHQFPNTPKHSFTLWTNYDVTPKFTVGGGAFYMSKVFGDTANLRAVPSYWRFDAMAQYRINKKLDLQLNVSNLFNRTYFDQAYPAHYASIAPGRSAFVTLNARY

SEQ ID NO: 54 - protein, 759 aa, Burkholderia pseudomallei
MARRPLRAALFGAFGLYAAAARAAGPASEPAAAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEVSPALIPYAQYAHGFRTPTPDQINNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 55 - protein, 750 aa, Burkholderia pseudomallei
MRYGVAGPERSRRGAAPVGRFGGRRWRSSLCLGVLIAAHPGAAALAGTAAKSDAQKNDMQRNENVREDTRRLAAGAPPAGGELKAISVSAPKDAADDPSVATVGKMPLALREIAQSVSVTTRERIEQQNLFSLDDVMQQSAGVTVQPYVLLTTAYFVRGFKVDSFEFDGVPVVLGDMASAPQDMSAYERAEILRGANGLLHGSGNPAATVNLVRKRPQHRFAASASVGSWGRYRAQADIGGPLNPAGTVRGRLVAAYEDRGFFYDRAKQDTRSIYGIAEIDVARDTLVTVGAQYQSVASVPDMSGVPMARDGTSLGLPRSTFLDVGWGHFDWDTTRVFGSVERKLGGGWKAKVSGEYQAVRSDLKYAGAYGAIDRATGAGGTLMGSAYQFSSYSRSVDANVQGPVRAFGLTHELLFGATYASSSSGQLTAPLLAGAGTPVNVYRWNPDGVPEPGVGPYRQDMQNDISQKGVYGLGRIKLAQPVTLVLGGRLSWWNQDSLGAHYNAGRQFTPYGGLIWDVARDWSWYASYAEVFQPQTKPTWDGGILTPVKGRTYETGIKGELAGGKLNVSLAAFRIDLDNNPRIDATRPCAGRSCYYVNGGSVRSQGFEFEANGRITPWWSVWASYTFDTIRYAKDVANGGAFAAELTPRHLLRVWTNYDLPWQERRWSVGGGVQVQSDFSAASSGVTMRQGGYALASVRLGYRYDRHWRAALNINNLFDRTYYQSLSQPGWNNRYGEPRNVMLTVRGQF

SEQ ID NO: 56 - protein, 756 aa, Burkholderia pseudomallei
MSRAPHAPSRRRAFGRGFAAAARAAHGAPVAHGVHACFAAASRRSTAVECCVTALACAVTASGALAAEAEPADAARGPHRELPTVRVTSDGAHASPLSTPLAAGSRLKLASLDTPASVEAITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDVDLAFYARNLANRTYAASTSNGGAQWLLGPSRSVELVATLRF

SEQ ID NO: 57 - protein, 749 aa, Burkholderia pseudomallei
MTSTFLRHAPTARGDHARRRRRAITLTVPALAAGAFHLAPAVAQTSEAVHGHGTLGASGVASRADTDAASAKSDGAVREAASAAASRTTTGAAPDATTLPTIEIVAAPESTPLVVVTDPKTPRQPLPASDGADYLKTIPGFASIRSGGTNGDPVLRGMFGSRLNILANGMPTLGACPGRMDAPTSYIAPESYDKVTLVKGPQTVLYGPGASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIDAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITQATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKAYAEHLNLAGNAGFGYPANLPVTEPGRTAWVRLSTKL

SEQ ID NO: 58 - protein, 821 aa, Burkholderia pseudomallei
MHAPCMPQFAPQFAPRRVVARVAAAALFSACAAPGVSGAAEPAAATRAYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYAGNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 59 - protein, 215 aa, Burkholderia pseudomallei
MNTKIATRLSVFALAGALLAGCATQQGTNTAVGTGTGAALGAGIGALAGGGKGAAIGAGVGALVGGVTGYNWQAIKNKLAPSAQQTGTQVTEQPDGSLKLNVPSSVTFATDQYAITPAFTPLLNDLATTLNQNPQITASVVGYTDSTGSAAHNQTLSQNRAQSVVNALAQRGVAANRLSAQGMGASNPIADNATEAGRAQNRRVEIYLRAPQAAQ

SEQ ID NO: 60 - protein, 170 aa, Burkholderia pseudomallei
MMSKKLRLAFAMLMIGALAACKSGVKLDEHANQGDAVSTQPNPENVAQVTVDPLNDPNSPLAKRSVYFDFDSYSVQDQYQALLQQHAQYLKSHPQRHILIQGNTDERGTSEYNLALGQKRAEAVRRALSLLGVGDAQMEAVSLGKEKPVALGHDEASWAQNRRADLVYQQ

SEQ ID NO: 61 - protein, 224 aa, Burkholderia pseudomallei
MNKLSKLAFIAATAVMAASASAQSVPASRQAVNDNWVNGTGEWVWMNGTNELCWRDAFWTPATANAKCDGALVAQAPAPAPVAPVAPAITSQKITYQADTLFDFDKAVLKPAGKQKLDELAAKIQGMNVEVVVATGYTDRIGSDKYNDRLSLRRAQAVKSYLVSKGVPANKVYTEGKGKRNPVTGNTCKQKNRKQLIACLAPDRRVEVEVVGTQEVQKTTVPAQ

SEQ ID NO: 62 - protein, 379 aa, Burkholderia pseudomallei
MKKTLIVAALSGVFATAAHAQSSVTLYGLIDAGITYTNNQGGHSAWSQSTGSVNGSRWGLRGAEDLGGGLKAIFVLENGFGINNGTLKQNGREFGRQAFVGLSHEQYGALTLGRQYDSVVDYLGPLSLTGTQFGGTQFAHPFDNDNLNNSFRINNAVKYTSVNWAGLKFGALYGFSNNNQFANNRAYSAGVSYSYAGFNIGAGYLQLNNNFGPTVSNASGAVALDNTFVGKRQRVFGGGLNYTFGPATAGFVFTQSRVNRATAIGAGASGVSSGIALDGTFMRFNNYEVNARYAITPAWTVAGSYTYTAGFIENHHPGWNQFNLQTAYALSKRTDVYLQGVYQKVNNDGTGLGAYINGIGGMSSTEKQIAVTAGLRHRF

SEQ ID NO: 63 - protein, 384 aa, Burkholderia pseudomallei
MKKHVISAAALLAFAAPVFAQSSVTLYGVIDEGFNYTSNVNVNGVGKSNYQLASGFVQGSRWGLRGSEDLGGGLKAIFTLENGFDVNNGRLGQGGRMFGRQAFVGLSHAQYGSLTLGRQYDSLVDYLAPLTANGNWGGTLFSHPFDNDNTDNSFRVNNTVKYASPDWNGLQVGGTYSFSNATGFSNNRQYSIGAAYTLGGLQLAAAYLQANNPGKTAGGAIADNDANFTADRLRIFGGGVNYTFGPATVGFVYTKTDVKNPVSTVYLPTATFAGLGLSATKFQNFEINGKYQLTPALFIGAQYVYTDGKFDAAAGSVKPKYHTVGLMADYNLSKRTDVYLQGAYQKVAGDKTGTIADGGYVVGTDGPSASANQFAVRAAIRHKF

SEQ ID NO: 64 - protein, 374 aa, Burkholderia pseudomallei
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHRLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTTRADNYEANVKYNLTPALGLGVAYTYTNAKANGESTHWNQVGVQADYALSKRTDVYAQAVYQRSSKNANASIYNGDLSTPFSTSINQTAATVGLRHRF

SEQ ID NO: 65 - protein, 384 aa, Burkholderia pseudomallei
MKKLALSTLSLALLGAAGAAQAQSSVTLYGVIDTSITYVHGNDGKANNAWLMGSGNLQGSRWGLKGTEDLGAGLKAIFQLENGFNSNDGTLGQGKRMFGRQAFVGLQHDQYGTLTLGRQYDPLVDLVQPVTADNYFGSLFATPGDVDNNDNSLRVNNTVKYTSPVFAGFQFEALYGFSGIAGSPGQGQTWSAAAAYNNGPIGVAAGYFYTSNPSPTAGSRSTWSGSSDAIFDGAINSGYTSAKSIGIAQVAGQYVFGPVTVGLGYSNAQYKPDGFSGFSSTEKYNTGRGFVTYQATPALLLGLGYAYTKASGDTDAKYHQVSIGADYALSKRTDVYLAGAYQHASGTQRVDATTTQTAQASIGSYGVNGTKSQEMVALGLRHKF

SEQ ID NO: 66 - protein, 516 aa, Burkholderia pseudomallei
MKAMMKPRARRRGARAARRPNGPRAWPLAVAAALVAGCTLAPRYERPAAPVPAHYWSTATGAPREAGPAAAGGPRAMPDARRGDAGRDARDARLDDWRAYFTDPALRALIDAALANNRDLRIATLRIQEARGLYGVARADRLPSIDGSLGYERTRLYDPVLRESATSSLYRASVGVSAFEIDLFGRVKSLSDAALAEYFATAEAQRAARISLIAEVASAYVTERALVDQLGLAERTLAARDAAYALTQRRYAAGTSTAIELRTAEMLVASARASKAALEREHTQAASALKLLAGDFMTALPADAPALDALAVARVSPGLSSDLLEQRPDIRQAEQRLVAANANIGAARAAFFPRIALTTDVGSVSDAFSGLFSAGSSVWTFAPRLTLPIFAGGRNRANLDVADARKHIAVAEYEKTIQTAFREVADALAARDQIDAQLAAQQAVYGADAERLRLAQRRYDSGVASYLELLDAQRSTFESGQELIRLKQLRLTNAITLYRALGGGWSRAGCGGDGCA

SEQ ID NO: 67 - protein, 514 aa, Burkholderia pseudomallei
MKRKHALTALAVALLAAGCTLAPRYERPAAPVSGAFPADGVYAAQPGAAPGARSANGQAAVDIGWREFFVDPCLQRLIEIALKNNRDLRVSVLNVEASRAQYQITRAGLFPTLSGTGTGTIQRTPAGVSITGQPLISRTYNVGVSASWELDLFGRVQSLKDQALAQYFATAQARKAAEISLVASVADQYLTLLSTDDLLQVTQNTLKSARASYDLTKLQFDNGTGSELDLRQAQTVVETALASQQAQARARAQALNALVLLIGEPLPDDLPAGLPLNAQNLLTDIPAGLPSDLLTRRPDIMQAEETLRAANANIGAARAAFFPKISLTSAFGTASPTLGGLFKAGTAAWSFAPNIALPIFEGGQNIANLDLAHVQKRIEIANYEKAIQSAFREVSDGLAARGTYDQQIAALERNEHAQQRRYDLSDLRYRNGVDSYLSVLTAQTDLYSAQQQLISARLARWTNLVDLYRALGGGWLERAGETPRPADAPVDYGKAAPAPAAAVPAASASAPAAG

SEQ ID NO: 68 - protein, 158 aa, Burkholderia pseudomallei
MQGDKKVIEYLNAQLKNELTAINQYFLHARMYKHWGLEKLGKHEYDESIGEMKHADWLIERVFMLDGLPNLQDLHKLLVGEETEEILKCDLKLEQVSQATCKEAIAYCESVRDYVSREIFEKILDDTEEHIDWLETQIDLIGKVGIQNYQQSMMGSPE

SEQ ID NO: 69 - protein, 79 aa, Burkholderia pseudomallei
MIVCVCKSVSDRKIRASLAEGVNTFEELQFELGVATCCGKCEETVREIMAEQGVCASRCGAERPAAVPVAVTFYERKAA

SEQ ID NO: 70 - protein, 306 aa, Burkholderia pseudomallei
MLNFLVKRLFGLLPTLACVAVLVFLFVHLLPGDPARLAAGPEADDATVALVRADLGLDKPLPAQFASFFARIAHGDFGVSTRSKRPVATEIGERFMPTLTLTVVSMAWATLFGMAIGIASAVWRNRWPDRIGMTLAVSGISFPAFALGMLLMEVFSVKLGWLPVVPDGSWKSYVPPSVTLGAAVAAVMARFTRASFVEVLNEDFVRTARAKGVREPMVVLKHCLRNAMIPVVTMMGLQFGFLLGGSIVVEAVFNWPGLGRLLVDAVTMRDYPVIQAIVLLFSLEFILINLSVDVLYAVINPTIRFK

SEQ ID NO: 71 - protein, 400 aa, Burkholderia pseudomallei
MKKRTAVAMTAAGLAAVATAHAQSSVTLYGIVDNGIAYQSSSTSLGSTTGGRSAVKMSTGVWAGSRFGLKGSEDLGGGSKAIFQLESGFSTANGTSQFAGGIFTRQAWVGLTNPTYGTLTAGRQYTAYYTLLSPYSPTTWLTGYFGAHPGDIDSLDTSYRTNNSLVYLSPKFYGFTFGGSYAFGGQPGSVNAGSTWSAGIQYMNGPLGIAAAFQRVNNSTSGGGDWGANSTTSNGGAQTAVSAINNGYKTAQAQQRVAVTAGYQFSSAWDISVSYSNVQYIPGVNSTFRNTAIFNTAGAVLHFKPSAQWDFAGGYAYTRATQSNGITSAAQYHQFTLSQYYSLSKRTGLYAVEAYQRANGKTLAGGKIIDATASIGDGFNTSPSSSRSQVGVGVGLIHRF

SEQ ID NO: 72 - protein, 498 aa, Burkholderia pseudomallei
MKTFPLSACRTAVAVAVAALALAGCANYFGLKSDKAIAPAAQFESARSLPAQGGQWPSLDWANQFGDPQLPKLIDEALEGNPTIAQAQARIAKASSYIESSRSTLLPKADAKYSWTRELYSGNALFPPPYGGQWYSENNALASASWELDLWGKNRARLNAAVSQEKAAEADLQQARVTLATSVARTYNQLAQLYALRDIAGREISNRQTVGKITDGRVGAGLDTNVERQTARGNIATSQSTLSDLDGQITNVRYQLAALLGKGPDRGLQIAAPVLSAGGAVALPENLPADLVSRRPDLVAARWQVEAAMHDVKEAKAEFFPDINLAAGFGFDAFGWGRFLNFASRQAQFGPAIHLPIFDGGALRAQLKGRYADFDLSVANYNQTLINALNDVATQVASIRSVDTQMGDAQRALDASTRAYELAVIRYKAGLSPQLQVLNADSNRLAAEQTVTNLKMRRRDLQIGLVKALGGGFDAAGTRLAAPAPASAPAAPAQHASN

SEQ ID NO: 73 - protein, 778 aa, Burkholderia pseudomallei
MFHQLAAPGARRRLAAACAAALAWPAAHAASTAAAVPADSTPAAAAEMTASGKTLDTVKVTAQRAAFAPDAPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSATASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPGWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 74 - protein, 698 aa, Burkholderia pseudomallei
MDDHRRIAPPFARRLHPLSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGKLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 75 - protein, 420 aa, Burkholderia pseudomallei
MRVERVPYRLITVATAAVFLAACGKKESAPPPQTPEVGVVTVQPQPVPVVSELPGRTSAYLVAQVRARVDGIVLRREFTEGSDVKAGQRLYKIDPAPYIAQLNSAKATLAKAQANLATQNALVARYKVLVAANAVSKQQYDDAVAAQGQAAADVGAGKAAVETAQINLGYTDVVSPITGRVGISQVTPGAYVQASQATLMSTVQQLDPVYVDLTQSSLDGLKLRQDIQSGRIKTEGPGAAKVTLILEDGKPYPERGKLQFSDVTVDQTTGSVTIRAIFPNKQRVLLPGMFVRARIEEGVNENAFLVPQIGVTHDPKGQAIAMIVDGKGKVEPRVLVTGGTQGQNWVVESGLQAGDRVIVQGIDKVRPGMTVKAAEAQLPAAAAGASGAAPAGGSPAQAAAASAAASGAAPSSAAAASSAQ

SEQ ID NO: 76 - DNA, 2265 bp, Burkholderia pseudomallei
ttaccagttgtatttcgcggtcgcgatcacggtgcgctggttgccgtacatgcacaccgcatccgactggcagccggccacgtagcggcggttgaacaggttcgtcgcgttgagcgcgaaacgccagttgcgcagctcgtagtgcagcgccgcgtcgaacagcgtgtagctcggcaccgtgagcgaattgtcggccgcgcccgccgccgcgctcatgtagcgcacgcccgcgccgacgccgaagcccgtgagcggcccggtgcgccacgtccaatcggcccacagcgacgcgatctggcgcggccgcggcacgtcgacgggccacttgttcagcgtgttgtcgttcgcccgcacgttcttcacgtcctgatagacgtacgcggcgatcaccgacagctcgcgcgacaggttgcccaccgcgctcagctcgacgccgcgcgagcgcacctcgcccacctgcacgaacgtgctgctcgtcgggtcgttcggattgctcatcgcgacgttcgtctggttgatctggtagacggccgcgttcagcatcaggttcttgccgggcggctgccagcgcaggcccgcctcgatctggcggcccttggtcggcgtcgcgagcccgccgcccgcgagcttcaggccgatctgcggattgaacgacgtcgaatagctgagatacggcgcgagcccgtagtcgccgagatacgtgaggcccacgcgcccgctgaacgcgtggtcgttctgcctgaagctcgccgcgttcgcgatgtcgtcctgcgacgtgcgcgtccagtcctgccggccgccgagcgtgagcacccagcgccgccacttgatctggtcctgcacgtacaggccgaatgcgttcagcgtcgtcttcgtgtcggtgcgcgggtacgcgttcggcccgctgaagatgtcggacggaatcggcgtgtagacgggccggtacaggttcaggctcggccccttcgcgagccattcgctatcggtcgtcgtctggcggttgtagtcgaagccgaacagcagcgtgtgcgaaagcgggcccgtcgtgaatttcgcctgcgcctggttgtcgacgtcgaagcggctgtagttgaactggaacaggcccgcgtagcgcgtcatcgtcgccatcgtcgggtctgcgtcgtcgaggccgccgccgtagacggacgcgtcgtcgagcgacaggtgcatccagcgcacgttctgccgcagcgtccacaccgggttcagcttgtgctcgaactgatagccgagcgaccactgcttcttgcggtaatggtcgaagttcgcatcggccgtgtacagatcgtccgagatcgtgccgttcggattcggcagcacggtgccgcgcgacggcaggaagttgctcgacgtgtcgccccagtcctgcaggtacgtcgcggcgagggtgagcgacgtgtccgcgttcggctgccatttgagcgacggcgcgaacgacacgcgctggtcggcgagcggccccgtctgcgcgttgccgtcgcggccgacgccgacgatccggtacgacagcgtgccgtccttgccgatcgtgtcgccgatgtcgaacatcagctgcttgcgcgcgtagttgccgacctgcacgccgagctcgcggatgcgctcgccgttcgcgagcttgctctgcacgtcgacgatcgcgccgggatcgccctgcccgtacagcaccgacgtcgggccgcgcagcacggcgatgctgtcgatcatgtacggatcgacgcgccagctcgacaggttgatcgtgttcggcacctgcagcccgtcgacgaacacggtcggcgtgaagccgcgcagcgccgcgtaccagtccgaacggttgtccgacccgtagctcgagaagcccggaatgtagcggaacgcctgattgatgtcggtcgcgcccgtcgcctcgatctgctgcgcggtgacgacgttgatcgtctgtggaatctcgatgatcggcgtatccgttttcgtgcccgtcatgctgcgccgcgcgacgaggccgacgctcgcgtcgcgctccgctgctcccgacaccgagatcgcgggcaacgtgccgcccgccgcggtgtctgccttcgcctcgccgcccggctgccgcgcgtccgcccccggctgcgccgcctgtgcctgcgcatgacccgccgccgccgcgtagaacgccacgccggccgcgatcgcacgcacgcgcgtgctggttgcccactccatcttccgttgctccaagttgcaaagcggccgcgagggccgcaccttcatcaa

SEQ ID NO: 77 - DNA, 1533 bp, Burkholderia pseudomallei
atgaacaagaccaacatcaacgaacgcatcgcgcgcgtcgcgaagatcgcggcggcgagcgggttgctcgtcgcgctgctcgccgcgtgcgcggtggggcccgactaccggcggcccgatgtcgcgacgcccgcggcgttcaaggaagcgccggcgctcgcgccgggcgagcaggccggcacgtggaaggcggccgagccggccgacgccgcgcatcgcggcgaatggtggcgcgtattcggcgatccggtgctcgatgcgctcgaaacgcaggcgcttgccgcgaaccagaacctgaaggccgcggcggcgcgcgtcgagcaggcgcgcgcggcgacccgcgccgcgcgctcgcagtggttcccgcaagtgggcgtgggcttcgggccgacgcgcgaggggctgtcgtcggcgtcgcagttccagccgcagggaagcggcccgacgaacgcgacgctctggcgcgcgcagggcacggtgtcgtacgaagcggacctgttcggccgcgtcggccgcaacgtcgaagcgtcgcgcgcggacgaagcgcagagccaggcgctgttccgctcggtgcagctcgcgttgcaggcggacgtcgcgcagaactacttcgagctgcgccggctcgattccgaccaggatctgtaccggcgcacggtcgggctgcgcgaggaggcgctcaagctcgtgcagcggcgctttgccgaaggcgacatcagcgagctcgacgtgtcgcgcgcgaagaacgaactggcgaccgcgcaggcggacgcggtgggcgtcgcgcggcggcgcgccgcatcggagcatgcgctcgcgatcctgctcggcaaggcgcccgcggatttctcgttcagcgagacgccgatcgcgccggtggtggtgcgcgtgccggcggggctgccgtcggcattgctcgagaggcggcccgacatcgcggcggccgagcgcgcgatgatggccgcgaacgcgcgcatcggcctcgcgaagtccgcgtacttcccgaagctcgacatcaccggcgcgttcggctatgaggcggcgacgctcggcaacctgttcctgtggtcgagccgcacgttcctgctcgggccgttcgcgggcacggcgctcacgctgccgatcttcgacggcgggcgccgcagcgcgggcgtcgcgcaggcgcgcgcgaagtacgacgaggaagtcgcgaactaccggcagcaggtgctcgtcgcgttccgcgaagtggaggacaaccttgccgatctgcgtctgctcgacgatcagatccgcgcgcaaagcgacgccgtcaacgcgtcgcggcgcgcggcgaagctgtcgcgcacgcagtatcaggaaggcgcggtcagctatctcgacgtgatcgacagcgagcgctcggtgctcgaatcgcaactgcaatcgaaccagttgacgggtacgcaggcggtatcgacggtcaacctgattcgcgcgctcggcggcggctgggggagcgatgctgcgctcggctcgcgcgagccgggcaagcaggacgtcgcgacgcgttga

SEQ ID NO: 78 - DNA, 2247 bp, Burkholderia pseudomallei
atgaagtcgcgttccgacgagttgaagctcggaaaattcaccaccctctgcagcgtgctggccgcgagcccggcattcgcgcaggacgccgcgccgcccgcggcgagcgccgatcacgacaaggagctcgcgccgatccagatcaagggcgccgccgaacacagctacaaagccgacttctcgtcgtcggtgaaattcaccgcgccgctcgtcgacacgccgaaatccgtcaccgtgattccgcaggaactgatccacaacagcggcgcggccacgctcaccgaagcgttgcgcaccgtgcccggcatcacgttcggcgcgggcgaaggcggcaatccgctcggcgaccgcccgttcatccgcggctacgacacgcagggcagcatgttcgtcgacgggatgcgcgacacgggcgcgacgacgcgcgagatcttcaataccgagcgcatcgagatcacgaaaggctcggacggcgcgtacggcggccgcggcggtgcgggcggcagcatcaacctcgtcacgaaggcgccgcacctgggcacgacggccgaggcgagcgcggggctcggcaccgaccgctatcgccgcttcaccgccgacggcaactggcagttcgccgatcacgcggcgttccgcctgaacctgatgagccacaacaacgacgtcgcgggccgcgacgccgtgaacaacgagcgctggggcgtcgcgccgtcgatcgcgttcgggctcggcacgccgacgcgcgtgagcgcgagctattaccacctgtcgaccgacgatctgcccgacggcggcattccgtatttctacacgacggcgaacaagccggcgaacgtcgatacgatctatccggcgaacgtcgaccgccacaacttctacggcctcgtcaaccgcgacttccgcaagacgacgacggacatcggcacgctgcgcatcgagcacgacatcacgccgtcgctgacggtgcgcaacaccacgcgctacacggaatcgacgcaggactacatttggacgcagcccgacgacagccagggcaacgtggtcaacggccgcgtctggcggcgcaacaacaaccgcaatagcgcgatcaacagcatcgcgaaccagaccgagctgttcggcgaattccgcaccggcccgttcaagcacagcttcacgaccggcatcgagctgtcgcgcgaatggggcaagcgcgattcgtacagcgtcgcgaccggcaccggcaagatctgccaacagggcatcggcgccgcgtcgggctacaactgcacgagcctggggtcgccgaacccgaacgatccgtgggcgggctcgatcacgcgcaacaacgactacgcgcatgcgcgcaccgtcacgaaatcgctctacggcttcgacacggtcgagctgagcaagcattggcaggtgaacgccggcgtgcgcgtcgacgactactcgacccgcttcaccgacacccgcgcgaacggcggcaagacctacacgcgcgacgacacgctcgtgaactggcagctcggcctcgtgttcaagcccgcgcgcaacggcagcgtgtacgcttcgtacgcgacgtcgtcgacgcccgcgggcgcgctgctcggcgaaggctcggagacgcagtcgctcacgccgggccgcggcggcgtcggcgcgaacgcggatcagctcgcgccggagaagaaccgcagcatcgagctcggcaccaaatggaacgtgctcgacgacaagctctcgctcacggccgccctgttccagatcgacacgacgaacgcgcgcgtcacgctgccgaacaaccagtacgcgatggtcggcaacaagcgcgtgcaggggctcgagctcggcttcgcggggcagctcacgcgcgcgtggcaggtgttcggcggctacacctacatgaagagcgaactgcgcgacaacggcaggaacaccgcggacaacggccatcagtttccgaacacgccgaagcacagcttcacgctgtggacgaactacgacgtgacgccgaaattcaccgtcggcggcggcgcgttctacatgtcgaaggtattcggcgataccgcgaacctgcgcgccgtgccgtcatactggcgcttcgacgcgatggcgcagtaccggatcaacaagaagctcgacctgcagctgaacgtgagcaacctgttcaaccgcacgtacttcgatcaggcgtatccggcgcactacgcgtcgatcgcgccgggccgctcggcgttcgtcacgctcaacgcgcgctattga

SEQ ID NO: 79 - DNA, 2280 bp, Burkholderia pseudomallei
tcagaaatccaccttcatgctgaccgcgacgctgcggcccggggcggtgtatgcgtcgagcacgttcgaatcggcggcgatgccgcgcacgtccgaccagttccagtacttgcggtcgaacaggttgtgaatgccgaggtaggcgctcacgtgcttgttgaagcggtagccgccgcgcagatcgacgacgaacgacgacggcggcgtgaagcaggtctttttctggcacgcggccgacgacacgtcgcggccgcgcttgcccgcctgccacagcaggtccgcctgcgcgaaccagcgctcgctcggctcgtagcgcacgccgaacacggcggagaacgggttgaccgtatcgagcggctcgctcgccgcgccgttgtcctgcgtcgtgcccttcgtgaacgccatcgccgtcttcagcgtgaagccattcggcatcacccattcggcgcgtccctcgaagccgtgaatgcgcgcgttcgcgaagttcacgtactggaacacgagcggatcgttcggccggccactgccgcccaccgtgcgctgcgagatgaagttgcgatagcggccggcgaacgcggcgacgctgtagcgcagcggcccgtagccggtgccgagcgtgccgcgcaggcccgcttcgagcgtgtcgctcgtctcgggcttcaggttcggattgccgatcgacgtatagccatagatcggattcgagaagctgttgttgatctgatcgggcgtcggcgtgcgaaagccgtgcgcatactgcgcgtagggaatcagcgcgggcgacacttcatagagcatcgcgacgcgcggcgacagctcgtgatcgctcgagctgaccgtcttgccggtgaacagcggatcgcccgagctcgggctgagccgatacgcgtcgaagcgcaggcccggcgtgacgagcagcttgccgaagccgatctgatcctgcacgaacgcgccgaacagcgagtagtcggtgtccggaaacgccttgttcgggaacgattcgccggggctcgcgacggtgccctcgcgcaggctcttgatgcggtcgatgctgccgtcgacgccgtacagcagcttgtgcgcgagcggcccggtcgcgaagccgctctcggcgaacgcggagccgccgagcgcgcgctcgctgtagtggttcgagcgcgaacgcgattggagccgcccgccgcgcgtctcgaacgcgtcctgatcctgcgtcgactcctgatagtagaactgcacgtgcgcggtctggaacccgcgcgcggcggcgtcgcgcaaatcgtagtcgatactgaagcggttgcgctcgagcctgtcgttcgcggtgaggccgagcgttgtcggcggattgatcgccgacagcacgttcgtgtcgatccgccgccgcaccgtttcggcggcgagcttgatcgtgtcgcgcgcggtcggcgtgatcgtcagcttgccgagcagcgattccgtgtagacatcctgaggattcgcgcgcgtgcgccgcgtgctcgcggaattgtcgtcgccgtgcgtgtcgagttcgtggccgcggcggccggacgcgatcagcatcgcctgcacgcgatcgttgccgcccgccgccgtcacggtcgcgccgatgctgcggtcgaccgagtcgtagctcggccggaacgagaaataggtcttttttcgatggatcgacagcagatcggacggatctttcgtgatgaagttgacggcgcccgtcaggccgtcgctgccatacagcgcggacgccggaccgcgcaggatctcgatgcgcgcgagcgtgtcgagatcggcgtaatcgccgcggccggcttcgagcgggccgaacgagaacgcgctcggcagccggatgccgtcttccatcagcagcacgcggttgccttcgaggccgcggatgttgatgctcgaatcgccgtcgcggccgccgccgagcgcggcgttcgccgggcggtacgcggtgcgtcgcacggtgacgcccggctcgtagcgcagcgcgtccttgatgttgtcggcctgctgctcctcgaggtctgaatcggtgatcaccgatacgctcgccgcggtgcggctcgcggccgacgcggtgcgcgtcgcggtgacggtgatcggatcgagtgccggcgcgtccttgcgtgcggcggcgatcgccgcgtgccgcacctgcgacgtggatgcggcggatgcggcggccgcgggttcggaagcggggccggcggcgcgcgcggccgccgcatagaggccgaaggccccgaacagcgcggcgcgaagcggccgccgcgccaa

SEQ ID NO: 80 - DNA, 2253 bp, Burkholderia pseudomallei
atgcggtacggggtggcgggacctgagagatcgcggcgcggcgccgcgccggtcgggcgtttcgggggaaggcggtggcgctcgtcgctctgcctgggcgtgctgatcgcggcccacccgggcgcggcggcgttggccggcacggccgcgaagagcgacgcgcaaaagaacgacatgcaaaggaacgaaaacgttcgggaagacacccggcggctcgccgccggcgcgccgcctgccggcggcgagctgaaggcgatttcggtgagcgcgccgaaggacgcggcggacgatccgtcggtcgcgaccgtcggcaagatgccgctcgcgctgcgggagatcgcgcaatcggtcagcgtgacgacgcgcgagcggatcgagcagcagaacctgttcagcctcgacgacgtgatgcagcaatcggccggcgtgaccgtgcagccgtacgtgctgctgacgaccgcgtacttcgtgcgcggcttcaaggtcgattcgttcgagttcgacggcgtgcccgtcgtgctcggcgacatggcgagcgcgccgcaggacatgtcggcttacgagcgcgcggagatcctgcgcggcgcgaacggcttgctgcacgggtcgggcaatccggccgcgaccgtcaatctggtgcgcaagcgcccgcaacaccggtttgccgcgagcgcgagcgtcggcagttggggccgctatcgcgcgcaggccgacatcggcgggccgctcaacccggcgggcacggtgcgcgggcggctcgtcgccgcgtacgaggatcgcggctttttctacgaccgcgcgaagcaggatacgcgctcgatctacggcatcgccgagatcgacgtggcgcgcgacacgctcgtcaccgtcggcgcgcaataccagtcggtcgcgtcggtgcccgacatgtccggcgtgccgatggcgcgcgacggcacgagcctcgggctgccgcgatcgacgttcctcgacgtcggctggggccatttcgactgggatacgacgcgcgtgttcggctcggtcgagcgcaagctcggcgggggctggaaggcgaaggtgagcggcgagtatcaggcggtgcgctccgatctgaaatacgcgggcgcgtacggcgcgatcgatcgggccacgggcgcgggcggcacgctgatgggcagcgcataccagttcagcagctacagccgcagtgtcgatgcgaacgtgcagggcccggtgcgcgcgttcggcctcacgcatgagctgctgttcggcgcgacctacgcgagcagcagcagcgggcagctcaccgcgccgctgctggcgggggccggcacgccggtgaacgtgtaccgctggaacccggacggcgtgccggagccgggcgtcgggccgtaccggcaggacatgcagaacgacatctcgcaaaagggcgtctacggcctcggccgcatcaagctcgcgcagccggtcacgctcgtgctgggcgggcgcctgagctggtggaaccaggacagcctcggcgcgcactacaacgcgggccgccagttcacgccgtatggcgggctgatctgggatgtcgcgcgcgactggtcgtggtacgcgagctacgcggaggtgttccagccgcagaccaagccgacctgggacggcggcatcctgacgccggtgaagggccgcacttacgagacgggcatcaagggcgagctggcgggcggcaagctcaacgtatcgctcgcggcgtttcggatcgatctcgacaacaatccgcggatcgacgccacgcgtccgtgcgccgggcgcagctgctactacgtgaacggcggcagcgtgcgcagccaggggttcgaattcgaggcgaacggacgcatcacgccgtggtggagcgtgtgggcgagctacacgttcgacacgatccgctatgcgaaggatgtcgccaacggcggcgcgttcgcggcggagctcacgccgcgccacctgttgcgcgtgtggacgaactacgacctgccgtggcaggagcgccgctggagcgtcggcggcggcgtgcaggtgcagagcgatttctcggcggcgtcgagcggcgtcacgatgcgccagggcggctacgcgctcgcgagcgtgcggctcggctatcgctacgacaggcactggcgcgccgcgctgaacatcaacaacctgttcgaccgcacgtactaccagagcctcagccagcccggctggaacaatcgttatggggagccgcgcaacgtgatgctgaccgtgcgcgggcagttctga

SEQ ID NO: 81 - DNA, 2271 bp, Burkholderia pseudomallei
ctagaagcgcagcgtcgcgacgagctcgaccgagcgcgacgggccgagcagccattgcgcgccgccgttcgacgtcgacgccgcgtacgtgcggttcgcgaggttgcgcgcatagaacgcgaggtcgacgtcgcgcgtcgcccgccacgcgagcgacgcgtcgaacaccgtgtaagaaggcaccggcacgcggttcgcgtcgtcgccgtagcggggaccgacgtagcgcaggcccgcgttcgcgcgccagccgggcgcgaacgcccagccgatccacaggttcgcgctctgctgcgcgatgtcgtgcggcacgttgccggcgcgctgcacgaccgtgtcgccgacgcgctggtcgaacgcgtcgtagcgcgcgcgcagcaacgccgcgtttgcgtcgaccgtcacaccgcccggcagccgcacgccgcccgcgagctcgacgccgcgcgacgactggcggccgatctgctgcgcgcgcgccggattcagcggatcgacgctgacgaggccgcgcttgacgatgtcgtagacggcgagcgtccagtacgcgcgagcgccgtcgatctcgtgcttgatgcccgcttcccattgacgcccggtcgcgagcgtgtagttcgcctgcgacgccgacagcgtgacgagcgagcccacgccctgcgcacccgtcgtgtactgcgcgtacgcggcgaggcccggcgcgatctcgtagacgagcccgctgcgccagccggtgtgcgcgaacgtcttgtcgaacgcgccgcccgcgatcagatcgtcgcgatgaaacgacagatggtcgtaacgcagcccgctcacccacgcgagccgcggcaggacctcgagccggttctcgatgaacgccgcggcctgatgcgtgcgcgtgcgaaagcgcggcagcgtcggatcggggctcgcgaacgcgccgggatcgaagccggcggcggcgacggtcgattcgccgcgatacggcgcgttgttcgcgccgtcgaacgcgatctggttgaactcggcgccgagcacgagccggttcgcgcggccgaacacgcgcgagtcgatgcgtgcggtgaagcgctcgccgaactgccgctcgcgatggaagatctcgagatagtcgctgcgcgcgacggtgcgcgccgccgggtcgagcgcatacgattccgcgttgcgccaatggcggcgcgtcgcgagatagtagagctgggcatcgagcgtcacgccgttgcccgcgcgataggtcgcggcaagccgcgtccaggtgtcgtggtatgcgatcgtcgcgtcgccgacgttgtagttgcgctcgcgcagcgcgcgctcgagcacgccgttcgtcgccggcacgccgaaataggtcgccggcttctggcggccgtagtcgtaatcgagcgtgatcgacagacgcgaatcgacatcgagcttcagcgcgccgccgacggccgtcacgtgcgcgtcgccgcgctcgacgaagccgcgcgtgcgctcgtcgctcagatggaaacgataggaaagacgcgcgccgagcgcgcccgtcgtatcgagcgccacgcgcttttcgccttgcgtgccgatgcccgcctgcagcgtcgtcgagcgttcgcggcgcgggcgccgggtcacgacgttggcgacgccgccgatcgccccttcgccgtacagcaccgacgccggcccgcgcagcacctcgatgcgctcggcggaccacgtcgagaacgggaacgtgacggtgcccgcgccggggtagaggcgcacgccgtcgacaagcgtcgtcaccgattcctggccggcgaagccgcgcacgctgagcgccgtgccgccgttgccgggcgccgcggccgtgctgaagcccgtcgcgcgcgtgacggcgtcgacgatcgtgcgatcgccgcgcgcggcgatctgcgcggaggtgatcgcctcgacgctcgcgggcgtgtcgaggctcgcgagcttcaggcgcgagccggccgcgagcggcgtagacagcggcgacgcgtgcgccccgtcgctcgtcacgcgcacggtcggcagttcgcgatgcgggccgcgcgcggcgtcggccggttccgcctcggcggcgagcgcgccggacgccgtcaccgcgcacgcgagcgcggtgacgcagcactcgacggccgtcgagcgacgcgacgcggcggcgaagcacgcgtgcacgccatgcgcgacaggcgcgccgtgagcggcgcgagcagccgccgcgaacccgcgcccgaacgcgcgacggcgcgacggtgcatgcggcgcccggctcat

SEQ ID NO: 82 - DNA, 2250 bp, Burkholderia pseudomallei
tcagagcttggtgctcaaacgaacccacgcggtacggccgggttcggtgacaggcagattcgccggatagccgaaaccggcgttgcccgcgaggttcaggtgctccgcataagccttgtcgagcacgttgtcgacgccgaccgagatctgcaccgtcttgctcacgttgtactgcgcgtgcagcgacagcacgccgaaaccggcgctcggaccaaagtccttgccgacgacgttgccctcgttcagcgcgtagcgatgctgcggcgcaacgacccgccacagcccgcccgccgaccacggcccgcgagtgtactcgacgccgaagcgtgcctcgagcggcggcatctgcggcagcggcgcaccgctttgcacgttgcgcccccacgcatacgcgagcgacccttcgaagcgccacggcgcgagcggacgccacgacgcgcccacctcaccgcccatgatctgcgcgttgacgttcgtcgcctgcgtgatctgtcccatcgggcccgtcgcatagtcgaacaggatgaagtcctgcacgtagcccgcataggcggacacccaggcgtcgagcttgtcgctcttgtactgcgcgccgatgtcgagctgcgtcgtcttctcgggcttgatcgcggagaatgcgttgatcgaaccgttcgggccgcgcttggcggagaacagctcccagtaatcagggaagcgctgcgcatggccgatgcccgcgtaccacgtgacgggcagcgacgcgagatcacgctcgtagcgcacgaagccgctcggcagcacgcgcgagcgaagatcgtcgaacgtcggattgcgcatgctcatcttcatgccgcccgtcgtcgcgcgcttgtcgcgcgcggccgcatagtcgatccgcgcgccgccgatcacgcgcgacgcatcgctcgcataccaggtcagctcgccgaacgcgcccgcgttccacatgttcgcctgcggattccacggcttgtcgccgtagttctgcatccccatcgccgagcgcgagtcgaggcggttcgactgcgcatcgacgcccgtcacgagcttgaacgcgtcggtcaagcgcagcgtcgccgcgacgcgcgcgccgagcgtgcggcggcgcacttcggaggccatgcgcatcggcatgctgctcgtcggatcgggcatccgcaacgtgtagttgtccatcacgtgatcggcttcgttgtagaagacctgcgcatcgatgcgatcgagcacgtcgccgatgtgcttcttgtcgaacttcagaccgaacgtctcgcgccggaaatgcgcgccgtccattccgcggcccgcatagcgcgcgtagccgtcgcccgtgcccgccgtcagctcgagccgcgtgttgtcgtcgggcgtccagccgagcgccgcgtccgcgttccacttgtcccattgcgacggcaccgtgcggccgttgccgtcctcgtagtcctgcgagtgcgcatggttcgcgctcacgcgcccgtagaagtcgggcgtgccggccgtcacgtcgacgttctgatcgttgcgcccgaacgagccgccgacgacgctgccgtcaaagcgcatgcccggcgtcttgaagcgcggcgtcacgcgctcgaacagcaccgtgcccgccgatgcgcccggcccgtacagcacggtctgcggccccttgacgagcgtcaccttgtcgtagctctcgggcgcgatgtacgacgtcggcgcgtccatccggccgggacacgcaccgagcgtcggcatgccgttcgcgagaatgttcagccgcgagccgaacatcccgcgcagcaccgggtcgccgttcgtgccgccgctgcggatcgacgcgaagccgggaatcgtcttcagataatcggcgccgtcgctcgcgggcagcggctggcgcggcgtcttcggatcggtgacgacgacgagcggcgtcgattcgggcgccgcgacgatttcgatcgtcggcagcgtcgtggcgtccggcgcggcgccggtcgtcgtgcggctcgccgcggcgctcgccgcttcgcgaaccgcgccgtccgatttggcgctcgccgcgtcggtgtcggcgcggctcgctacgccggacgcgccgagcgtgccgtggccgtgcacggcctcgctcgtctgcgcgacggccggcgcgaggtgaaaggcgcccgcggcgagcgcgggaacggtaagcgtgatcgcgcgccgccggcggcgcgcgtggtctccacgcgcggtgggcgcgtgacgcaggaatgtggatgtcat

SEQ ID NO: 83 - DNA, 2466 bp, Burkholderia pseudomallei
ttgcacgcgccgtgcatgccgcaattcgccccgcaattcgccccgcgccgcgtcgtcgcgcgcgtggccgccgccgcgctgttctccgcgtgcgccgcgccgggcgtatcgggcgcggccgagccggccgccgcgacgcgcgcgtacgacattccggcgggcccgctcgacgcggcgctgacccgcttcggccgcgaggccggcatcctgctgtcgttcccgggcgagctgaccacgggcctgcgaagccccgggctgcacggccgcgcggatccggccgcggcgctcgaccggctgctgacgggcacggggctcgtcgcgctccggcagccgagcggcggctacacgctcgccaggctgcccgggccggccgccgccggcgccgatgccgcgctcgcggccgacacgacgctgcccaccgtcgccgtgcgcgcgagcggcccgcacgcggacagctaccggccgccgcgcgaggcggcggggctgcgcagcgacgcgccgctcgccgaggtgccgcaagcggtcgccatcgtcgcgcagcaggtgctgcgcgaccagcgcccgcgcaatctcgacgacgcgctcgcgaacgtgagcggcatcacgcagggcaacacgctcggcagcacgcaggacacggtgatgaagcgcggcttcggcgacaaccgcgacggctcggtgatgcgcaacggaatgccgatcgtgcagggccgctcgctgaacgcgacgacggacagcgtcgaagtgctgaagggcccggcctcgctgctgtacggcatcatggacccgggcggcgtgatcaacgtcgtcacgaagcagccgcagctcgcgcgccgccacgcgatctcggcgctcggctcgacgtacggcggcggcaggaacggcggcgagctcacgttcgactcgacgggcgcgatcggcgagtcgcgcgttgcataccggctgatcgtcgatcagacgaacgaacagtattggcgcaactacggcgagcaccgcgagacgctcgtcgcgccttcgctcgcgtggtacgggcgcgatacgcaggtggtgctgtcgtacgagtaccggcgcttcctgatgccgttcgatcgcggcaccgcgctcgatccgcgcacgaacgcgccgctcgcgatcccggcgcgccgccggctcgacgagccgttcaacgacatgcgcggcgaatcgaatctcgcgcagctcgcgatcgatcatcagctcgcgccggactggaaggtgcacgtcggctacagctacaaccgggagacctacgatgcgaaccagattcgcatcacggcggtcgatccgctcaagggcacgctcacgcgcagcaacgacgcgacgcacggctcgcgcagcaccgacagctacggcatcgcgtacgtcgacggccgcgtgacgctcgccgggatgcggcacgacgtgcagttcggcgtcgacggcgaataccggcaggtctaccgcgcggacatgctgcgccagccgatcaagacgccgttcagctatctgaacccgacgtacgggctcgtcccgccgtcgacgagcgtatcggcctccgacagcgaccagagcgacacgctgcacaccgcctcgctgttcttccaggacagcatccatctgagcgagcggtggatgctcgtcggcggcgcgcgctgggtccgctacagccagcttgccgggcgcggccggccgttccaggtcaacacgaacctgagcggcacgaagtggctgccgcgcgcgggcatcgtctacaagtggaacgacgcgctgtcgctgtacggcagctacacgcagtcgctgaagccgacctcgaagatcgcgccgatggcgggcggctacgtgatcgacggctcgaccgcgcccgaggaaggcgcgtcgtgggagctcggcgcgaagctcgacatgccgggcggcctcgccggcacgctcgcgttcttcgacatcgacaagaagcacgtgctcgtctcgcaatacgacgacgcgacgaaccagaccgcgtggcgcacgtccggccgcgcgcgctcgcgcgggatcgagctcgacgtgtcggggcggatcggcgcgcgctggaacgtgatcgcgagctacgcgtacatcgacgcgaagacgaccgaagatccgctgtacgcgggcaaccggctgtggaacgtcgcgcggcacacggcctcgctcgcggcggtctacgacgtgggcacggtgctcggcggcgacgacctgcgcatcggcgcggcggggcgctacgtcggcgcgcgcccgggcgattcggccaacagcttcacgctgccggcgtacgcgaccgccgacgcgttcgcgacctacgacacgcggcttggcaagcagaagctgcagttccagctcaacgtgaagaatctgttcaaccgcacgtattacccgtcgagcgtgaaccggttcttcgtgtcggtgggcgacgcgcggcaggtgtcgctgctgacgacgctgcagttctga

SEQ ID NO: 84 - DNA, 648 bp, Burkholderia pseudomallei
ttactgcgccgcttgcggcgcgcgcaggtagatctcgacgcggcggttttgcgcgcggccggcttccgttgcgttgtcggcgatcgggttcgacgcgcccatgccttgcgcggacaggcggttcgccgcgacgccgcgctgcgcgagcgcgttcacgacgctttgcgcgcgattttgcgacagcgtttgattgtgcgcggccgagcccgtgctgtcggtgtagccgacgaccgacgcggtgatctgcgggttctggttcagcgtcgtcgcgaggtcgttcagcagcggcgtgaacgccggcgtgatcgcgtactggtcggtcgcgaacgtgaccgagctgggcacgttcagcttgagcgagccgtccggctgttcggtgacctgcgtgcccgtttgctgcgccgacggcgcgagcttgttcttgatcgcttgccagttgtaacccgtcacgccgccgacgagcgcgccgacgccggcgccgatcgccgcgcccttgccgccgccagcgagcgcgccgatgcccgcgccgagcgcggcgcccgtgccggtgccgacagccgtgttggtgccttgctgggttgcgcaacccgccagcagggcgccggcgagagcgaaaacggacaagcgcgtcgcgattttggtattcat

SEQ ID NO: 85 - DNA, 513 bp, Burkholderia pseudomallei
atgatgtcgaagaaacttcgtctggcgttcgcgatgctgatgatcggcgcgctcgcggcatgcaagtcgggcgtgaagctcgacgagcacgcgaaccagggcgacgcggtcagcacgcaaccgaatcccgaaaacgtcgcgcaggtgaccgtcgatccgctgaacgatccgaacagcccgctcgcgaagcgcagcgtgtacttcgatttcgacagctactcggtgcaggaccaataccaggcgctgctgcagcaacacgcgcaatacctgaagagccatccgcaacgccacatcctgatccagggcaacaccgacgagcgcggcacgagcgagtacaacctcgcgctcggccaaaagcgtgcggaagccgtgcgccgcgcgctgtcgctgctcggcgtcggggatgcgcagatggaagccgtgagtctcggcaaggaaaagccggttgcgctcggccacgacgaagcgtcgtgggcgcagaaccgccgtgcggacctcgtctatcaacagtaa

SEQ ID NO: 86 - DNA, 675 bp, Burkholderia pseudomallei
atgaataaactttcaaagctcgcgttcattgcagctaccgcagttatggctgcatccgcttcggcacagtcggtgccggcgtcgcgacaagccgtgaatgacaactgggtgaatggcacgggcgaatgggtgtggatgaacggcacgaacgagctctgctggcgcgatgcgttctggacgccggccaccgccaacgccaagtgcgatggcgcactggtcgcccaggcaccggcaccggcgccggtcgcaccggttgctccggccatcacgagccagaagattacgtaccaagccgatacgctgttcgacttcgacaaggccgtcctgaagccggccggcaagcagaagcttgacgaactggccgcgaagatccagggcatgaacgtcgaagtggtcgtggccacgggctacacggaccgcatcggttcggacaagtacaacgaccgtctgtcgctgcgccgcgcgcaagccgtcaagtcgtacctcgtcagcaagggtgtcccggcgaacaaggtctacacggaaggcaagggcaagcgcaacccggtcacgggcaacacctgcaagcagaagaaccgcaagcagctcatcgcctgcctcgcaccggaccgccgcgtggaagtcgaagtggtcggcacgcaggaagtgcagaagacgaccgttccggcgcagtaa

SEQ ID NO: 87 - DNA, 1140 bp, Burkholderia pseudomallei
atgaaaaagaccctcatcgttgccgctctttccggcgttttcgcaacggccgctcacgcgcaaagcagcgtgacgctgtacggcctgatcgacgccggcatcacctacacgaacaaccaaggcggccacagcgcatggtcgcaatccaccggctcggtcaacggcagccgctggggcctgcgcggcgccgaggatctcggcggcggcctgaaggcgattttcgtgttggaaaacggcttcggcatcaataacggcacgctgaagcagaacggccgcgagttcggccgtcaggcgttcgtcggcctgtcgcacgagcaatacggcgcgctgacgctcggccgtcaatacgacagcgtcgtcgactacctcgggccgctgtcgctgacgggcacgcaattcggcggcacgcagttcgcccacccgttcgacaacgacaacctgaacaattcgttccggatcaacaacgcggtcaagtacacgagcgtgaactgggcgggcctgaaattcggcgcgttgtacggcttctcgaacaacaatcagttcgcgaacaaccgcgcctatagcgcgggcgtatcgtacagctacgccggcttcaacatcggcgccggctacctgcagttgaacaacaacttcggcccgacggtctccaacgcatccggcgcggtcgcgctcgacaacacgttcgtcggcaagcgccagcgcgtgttcggcggcggcctgaactacacgttcggcccggcaacggccggcttcgtgttcacgcaatcgcgcgtcaaccgcgcgacggcaatcggcgcgggcgcatcgggcgtgtcgagcggcattgcgctcgacggcacgttcatgcgcttcaacaactacgaagtgaacgcgcgctacgcgatcacgccggcatggacggtggccggttcgtacacgtacaccgccggcttcatcgagaaccaccacccgggctggaaccaattcaacctgcaaacggcctacgcgctgtccaagcgcacggacgtgtacctgcaaggcgtgtatcagaaggtcaacaacgacggcacgggcctcggcgcgtacatcaacggtatcggcggcatgtcgtcgacggaaaaacagatcgccgtcacggccggcctgcgtcaccgcttctaa

SEQ ID NO: 88 - DNA, 1155 bp, Burkholderia pseudomallei
atgaaaaagcacgtcatttccgcagccgcattgctggccttcgccgcgccggttttcgcccaaagcagcgtcacgctgtacggcgtgatcgacgaaggcttcaactacacgagcaacgtgaacgtcaacggcgtcggcaagagcaactaccagctcgcgagcggtttcgtgcagggcagccgctggggcctgcgcggctcggaagacctgggcggcggcctgaaagccatcttcacgctcgaaaacggtttcgacgtgaacaacggccggctcggccagggcggccggatgttcggccgccaggcgttcgtcggcctgtcgcacgcgcaatacggctcgctcacgctcggccgccagtacgattcgctcgtcgactacctcgcgccgttgaccgcgaacggcaactggggcggcacgctgttctcgcatccgttcgacaacgacaacacggacaactcgttccgcgtgaacaacacggtcaagtacgcgagcccggactggaacggtctgcaagtcggcggcacgtacagcttcagcaacgcgacgggcttctcgaacaaccgccagtacagcatcggcgccgcgtacacgctgggcggcctgcaacttgcggccgcgtacctgcaggcgaacaacccgggcaagacggcgggcggcgcgatcgccgacaacgacgcgaacttcacggcggaccgcctgcgcatcttcggcggcggcgtcaactacacgttcggcccggcgacggtcggtttcgtctacacgaagaccgacgtgaagaacccggtctcgacggtctatctgccgacggcgacgttcgcgggcctcggcctgagcgcgacgaagttccagaacttcgaaatcaacggcaaataccagctgacgccggcgctcttcatcggcgcgcagtacgtgtacacggacggcaagttcgatgcggccgcgggcagcgtcaagccgaagtaccacacggtcggcctgatggcggactacaacctgtcgaagcgcaccgacgtctatctgcagggcgcgtaccagaaggtcgcgggcgacaagacgggcacgatcgcggatggcggctacgtcgtcgggacggacggcccctcggcgtcggcgaaccagttcgcggttcgcgcggcgatccgtcacaagttctga

SEQ ID NO: 89 - DNA, 1125 bp, Burkholderia pseudomallei
atgaacaagactctgattgttgcagcagttgctgcatcgttcgcaaccgtcgctcacgcgcaaagcagcgtcacgctgtacggtgtgctcgacgcgggcatcacgtaccaaagcaacgtcgcgacgccgtcgggctcgggcaagtcgctgtggtcggtcggcgccggcgtcgaccaaagccgtttcggtctgcgcggctcggaagacctgggtggcggcctgaaggcgatcttcacgttggaaagcggcttcaacatcggtaacggccgcttcaacaacggtggcggcatgttcaaccgtcaagcgttcgtcggtctgtcgagcaactacggcaccgtcacgctgggccgtcagtacgacgcaacccaagactacctgtcgccgctgtcggcaacgggcacctggggcggcacgtacttcgcgcaccggctcaacaacgaccgcctgaacacgaacggcgacgtcgcggtgaacaacacggtcaagttcacgagcgcgaactacgccggcctgcaattcggcggcacgtactcgttctcgaacaactcgcaattcgcgaacaaccgtgcatacagcgcgggcgcttcgtaccagttccaaggcctgaaggtcggtgcggcgtactcgcaagctaacaacgctggcgcgaacaccacgggcgcaacggatccgctgaccggcttcaacatcggcggcacgaacgcagcaagcatccaaggccgttcgcgcgtgtacggcgccggcgcaagctacgcttacggcccgctgcaaggcggcctgctctggacgcaatcgcgtctcgacaacctggcaaacggcgcgccgaccacccgtgccgacaactacgaagcaaacgtgaagtacaacctgacgccggctctgggtctgggtgttgcttacacgtacacgaacgcgaaggcgaacggcgaaagcactcactggaaccaagttggcgtccaggccgactacgcgctgtcgaagcgcaccgacgtgtacgcacaagccgtgtaccagcgttcgtcgaagaacgcgaatgcgtcgatctacaacggcgacctcagcacgccgttcagcacgtcgatcaaccaaaccgcagcgacggttggtctgcgtcaccgcttctaa

SEQ ID NO: 90 - DNA, 1155 bp, Burkholderia pseudomallei
atgaagaaactcgctctgtctaccctctcgctcgcgctgctgggcgcagccggtgcagctcaggctcaaagcagcgtcacgctgtacggcgtgattgatacgtcgatcacttatgtccacggcaacgacggcaaggccaacaacgcctggctgatgggcagcggcaacctgcaaggcagccgctggggcctgaagggcaccgaggatctcggcgccggcctgaaggcgatcttccagttggaaaatggcttcaactcgaacgacggcacgctcggccaaggcaagcgcatgttcggccgccaggcgttcgtcggtctgcagcatgaccagtacggcacgctgacgctcggccgtcagtacgatccgctcgtcgacctcgtgcaaccggtgacggccgacaactacttcggcagcctgttcgccaccccgggtgacgtcgacaacaacgacaacagcctgcgcgtgaacaacacggtcaagtacacgtcgcccgtgttcgccggcttccagttcgaagccctgtacggcttcagcggcatcgcgggctcgccgggccaaggccagacgtggtcggccgccgccgcatacaacaacggcccgatcggcgtcgcggccggctacttctacacgtcgaacccgtcgccgacggccggctcgcgctcgacgtggagcggctcgtccgacgcgatcttcgacggcgcgatcaacagcggctacacgagcgcgaagtcgatcggcatcgcacaggtggccggccagtacgtgttcggcccggtcacggtcggcctcggctacagcaacgcgcaatacaagccggacggcttctcgggcttctcgtcgaccgagaagtacaacacgggccgcggcttcgtgacgtaccaggccacgccggcgctgctgctcggcctcggctacgcatacacgaaggcgagcggcgacacggacgcgaagtaccaccaagtgtcgatcggcgcggactacgcgctgtccaagcgcacggacgtctacctcgccggtgcgtaccagcacgcgagcggcacgcagcgcgtcgatgcgacgacgacgcaaacggcgcaggcatcgatcggctcgtacggcgtgaacggtacgaagtcgcaagagatggtggctctgggcctgcgccacaagttctaa

SEQ ID NO: 91 - DNA, 1551 bp, Burkholderia pseudomallei
tcaagcacacccatcgccgccgcacccggcgcgcgaccagcccccgcccagcgcgcgatacagcgtgatcgcgttcgtgagccgcagctgcttcaggcgaatcagctcctgcccggactcgaacgtgctgcgctgcgcgtcgagcagctcgagatagctcgccacgccgctgtcgtagcgccgctgcgcgagccgcagccgctcggcgtccgcaccgtagaccgcctgctgcgcggcaagctgcgcgtcgatctgatcgcgcgccgcgagcgcatcggcgacttcgcgaaacgccgtctggatcgtcttctcgtattcggcgaccgcgatatgcttgcgcgcgtccgccacgtcgagattcgcacgattgcgcccgcccgcgaaaatcggcagcgtgagccgcggcgcgaacgtccacacgctcgagccggccgagaagagtcccgagaacgcgtcgctcaccgagccgacgtcggtcgtgagcgcgatgcgcgggaagaacgccgcgcgcgccgcgccgatgttcgcgttcgccgcgacgaggcgctgctcggcctgccggatgtccgggcgctgctcgagcagatccgacgacagccccggcgacacccgcgccaccgcgagcgcgtcgagcgcgggcgcatcggcgggcagcgccgtcatgaagtcgcccgcgagcagcttcagcgcgctcgccgcctgcgtgtgctcgcgctcgagcgccgccttcgacgcgcgcgccgacgcgacgagcatctcggccgtgcgcagctcgatcgccgtgctcgtgccggccgcgtaacggcgctgcgtgagcgcgtaggccgcgtcgcgcgcggcgagcgtgcgttcggcgagccccagttgatcgacgagcgcgcgctcggtcacgtacgcggacgcgacttcggcgatcaggctgatgcgcgccgcgcgctgcgcctcggcggtcgcgaagtactcggcgagcgccgcgtccgagaggctcttcacgcggccgaacagatcgatctcgaacgcgctcacgccgacactcgcgcgatacagcgagctcgtcgcgctctcgcgcagcaccgggtcgtaaagccgcgtgcgctcgtagccgaggctgccgtcgatcgacggcagccggtccgcgcgcgcgacgccgtagaggccgcgcgcttcctggatacgcagcgtcgcgatccgcaggtcgcgattgttcgcgagcgccgcgtcgatcagcgcgcgcagcgccggatcggtgaaatacgcgcgccagtcgtcgagccgcgcgtcgcgggcgtcgcgcccggcgtcgccgcggcgcgcgtccggcatcgcgcgcgggccgccggcggccgccgggcccgcctcgcgcggcgcgcccgtcgccgtcgaccaataatgcgccggcacgggcgcggccggccgctcgtagcgcggcgcgagcgtgcagcccgcgacgagcgcggccgcgaccgcgagcggccaggcccgcggcccgttcggccgccgcgctgcgcgcgcgccgcgccgccgggcccggggtttcatcatcgctttcac

SEQ ID NO: 92 - DNA, 1545 bp, Burkholderia pseudomallei
atgaagcgaaaacatgctttgactgcactcgcagtcgcgctgctcgccgcgggctgcacgctcgcgccgcgctacgagcgtccggccgcgccggtgtcgggcgcgttccccgccgacggcgtctatgccgcgcagccgggcgccgcgcccggcgcgcgcagcgcgaacggccaggcggccgtcgatatcggctggcgcgagttcttcgtcgatccgtgcctgcagcggctgatcgagatcgcgctgaagaacaaccgcgacctgcgcgtgtcggtgctcaacgtcgaggcgtcgcgcgcgcagtatcagatcacgcgcgcggggctcttcccgacgttgagcggcaccggcacgggcacgatccagcgcacgccggccggcgtgtcgatcaccggccagccgctcatctcgcggacctacaacgtcggcgtctccgcgtcgtgggagctcgacctgttcggccgcgtgcagagcctgaaggatcaggcgctcgcgcaatacttcgcgaccgcgcaggcgcgcaaggccgcggagatctcgctcgtcgcgagcgtcgccgatcagtacctgacgctgctgtcgaccgacgatctgctgcaggtcacgcagaacacgctgaagtcggcgcgcgcgtcctacgatctgacgaagctgcagttcgacaacggcaccggctcggagctcgacctgcgccaggcgcagacggtggtcgagaccgcgctcgcgagccagcaggcgcaggcgcgcgcccgcgcgcaggcgctcaacgcgctcgtgctgctgatcggcgagccgctgcccgacgatctgccggccggcctgccgctcaatgcgcagaacctgctcaccgacattccggccgggctgccgtccgatctgctcacgcggcggcccgacatcatgcaggccgaggagacgctgcgcgcggcgaacgcgaacatcggcgcggcgcgcgcggcgttcttcccgaagatctcgctcaccagcgcgttcggcaccgcgagcccgacgctcggcggcctgttcaaggcgggcacggcggcgtggtcgttcgcgccgaacatcgcgctgccgatcttcgagggtgggcagaacatcgcgaacctcgatctcgcgcacgtgcagaagcgcatcgagatcgcgaactacgagaaggcgatccagagcgcgtttcgcgaggtgtcggacgggcttgccgcgcgcggcacgtacgatcagcagatcgcggcgctcgagcgcaacgagcacgcgcagcagcgccgctacgatctgtcggacctgcgctacaggaacggcgtcgacagctatctgtcggtgctgaccgcgcagacggacctgtattcggcgcagcagcagttgatcagcgcgcggctcgcgcgctggacgaacctcgtggacctgtatcgcgcgctgggcggcgggtggctcgagcgcgcgggcgagacgccgcgcccggcggacgcgcccgtcgattacggcaaggcggcgcccgcgccggcggcggccgtgccggctgcgtcggccagcgcgccggcggcgggctga

SEQ ID NO: 93 - DNA, 477 bp, Burkholderia pseudomallei
ttattccggcgagcccatcatcgactgctgatagttctgaatgccgaccttgccgatcaggtcgatttgcgtctcgagccagtcgatgtgctcctcggtatcgtcgaggattttctcgaagatttcgcgcgacacgtaatcacgcaccgattcgcaataagcgatggcttccttgcacgtggcctgcgatacctgttcgagcttcaggtcgcatttcaggatttcctcggtttcctcgccgacgagcagcttgtgcagatcctgcaggttcggcaggccgtcgagcatgaacacgcgctcgatcagccagtccgcgtgcttcatttcgccgatcgattcgtcgtattcgtgcttgccgagtttttcgaggccccagtgtttgtacatccgcgcatgcaggaaatattgattgatcgcggtcagttcgtttttcaactgcgcgttcagatattcgatgactttcttgtcgccttgcat

SEQ ID NO: 94 - DNA, 240 bp, Burkholderia pseudomallei
tcaggccgccttgcgttcgtagaacgtgacggcgaccggtacggccgcagggcgctcggcaccgcaacggctcgcacaaacgccctgttccgccatgatctcgcgcacggtttcctcgcacttgccgcagcaggtggcgaccccgagttcgaactggagttcttcgaacgtgttcacgccttccgcgagggatgcgcgaatcttccgatcggaaacggacttgcacacgcagacgatcat

SEQ ID NO: 95 - DNA, 921 bp, Burkholderia pseudomallei
tcacttgaaacggatcgtcgggttgatgaccgcgtacagcacgtcgacgctcaggttgatcaggatgaactccagcgagaacagcagcacgatcgcctggatcaccgggtagtcgcgcatcgtcaccgcatcgacgagcaggcgcccgagccccggccagttgaacaccgcctcgacgacgatcgagccgccgagcaggaagccgaactgcagccccatcatcgtgacgaccggaatcatcgcgttgcgcaggcagtgcttgagcacgaccatcggctcgcgcacgcccttcgcgcgcgcggtgcgcacgaaatcctcgttcagcacctcgacgaacgacgcgcgcgtgaagcgcgccatcacggcggccacggccgcgccgagcgtcaccgacggcggcacgtagctcttccacgagccgtccggcacgacgggcagccagccgagcttcaccgagaacacctccatcagcagcatgccgagcgcgaacgccggaaacgagatgcccgacaccgcgagcgtcatgccgatgcggtccggccagcggttgcgccacacggccgacgcgatgccgatcgccatgccgaagagcgtcgcccaggccatgctgacgacggtcagcgtcagcgtcggcatgaagcgctcgccgatctcggtcgctacgggccgcttgctgcgcgtcgagacgccgaagtcgccgtgcgcgatccgcgcgaagaagctcgcgaactgcgccggcagcggcttgtcgaggccgagatcggcgcgcacgagcgcgacggtcgcgtcgtcggcctcggggccggccgcgagccgcgcgggatcgcccggcagcaggtggacgaacaggaacaccagcaccgcgacgcacgccagcgtcggcagcagcccgaacagtcgtttgaccagaaaattcagcat

SEQ ID NO: 96 - DNA, 1203 bp, Burkholderia pseudomallei
atgaaaaagcgcactgcggtcgcgatgacggccgccggactggcggctgtcgccaccgcgcacgctcagagcagcgtgacgctttacggcatcgtcgataacggcatcgcgtatcaaagcagcagcacgtcgctcggctcgacgacgggcggccgctcggcggtgaagatgtcgacgggcgtgtgggcgggcagccgcttcggcctgaagggcagcgaggatctcggtggcggctcgaaggcgatcttccagctcgaatcgggcttcagcacggccaacggcacgtcgcagttcgcgggcggcatcttcacgcgccaggcgtgggtcggcctgaccaacccgacgtacggcacgctgacggcgggccgccagtacaccgcgtactacacgctgctgtcgccgtatagcccgacgacctggctcaccggctatttcggcgcgcatccgggtgacatcgattcgctcgataccagctaccgcacgaacaattcgctcgtctacctgtcgccgaagttctacggcttcacgttcggcggctcgtatgcgttcggcggacagccgggcagcgtgaacgccggctccacgtggagcgcgggcatccagtacatgaacggtccgctcggcatcgcggcggcgttccagcgcgtgaacaactcgacgtcgggcggcggcgactggggcgcgaattcgacgacgtcgaacggcggcgcgcagacggccgtgtcggcgatcaacaacggctacaagaccgcgcaggcgcagcagcgcgtcgcggtgacggccggctatcagttctcgtccgcatgggacatctcggtgtcgtactcgaacgtgcagtacatcccgggcgtgaactcgacgttccgcaacacggcgatcttcaacacggcgggcgcggtgctgcacttcaagccgtcggctcagtgggacttcgcgggcggctacgcgtacacgcgcgcgacccagtcgaacggcatcacgagcgccgcgcagtaccatcagttcacgctgtcgcagtactacagcctgtcgaagcgcacgggcctgtacgcggtcgaagcgtatcagcgcgcgaacggcaagacgctcgcgggcggcaagatcatcgacgcgaccgcgtcgatcggcgacggcttcaacacgtcgccgtcgtcgtcgcgcagccaggtgggcgtcggcgtcggcctgatccaccgtttctga

SEQ ID NO: 97 - DNA, 1497 bp, Burkholderia pseudomallei
atgaaaaccttcccgttgtccgcttgccggaccgccgtggccgtcgcggtcgccgcgctcgcgctcgcgggatgcgcgaactatttcggcctcaagagcgacaaggcgatcgctcccgcggcgcagttcgaaagcgcgcggagcctgcccgcgcagggcggccaatggccgtcgctcgactgggcgaaccagttcggcgatccgcaattgccgaagctgatcgacgaggcgctcgaaggcaatccgacgatcgcgcaggcgcaggcgcgcatcgcgaaggcgtcgtcgtacatcgagtcgtcgcgctcgacgctgctgccgaaggccgacgcgaagtactcgtggacccgcgagctgtactcgggcaacgcccttttcccgcccccgtacggcggccagtggtacagcgagaacaacgcgctcgcgagcgcgtcgtgggagctcgatctgtggggcaagaaccgcgcgcgcctgaatgcggccgtgtcgcaggaaaaggccgccgaagccgacctgcagcaggcgcgcgtgacgctcgcgacgtcggtcgcgcgcacgtacaaccagctcgcgcaactgtacgcgctgcgcgacatcgccgggcgcgagatctcgaaccggcagacggtcggcaagatcaccgacggccgcgtcggcgcgggcctcgacacgaacgtcgagcgccagaccgcgcgcggcaacatcgcgacgagccagtcgacgctgtccgatctcgacggccagatcacgaacgtccgctatcagctcgccgcgctgctcggcaaaggtccggaccgcgggctgcagatcgccgcgcccgtgctgagcgcgggcggcgcggtcgcgctgccggagaacctgcccgccgatctcgtgtcgcgccgcccggatctcgtcgccgcgcgctggcaggtcgaagcggcgatgcacgacgtgaaggaagcgaaagccgagttctttccggacatcaacctcgcggcgggcttcggcttcgacgcgttcggctggggccgattcctgaacttcgcgagccgccaggcgcagttcggccccgcgatccacctgccgatcttcgacggcggcgcgctgcgcgcgcaattgaagggccgctacgcggacttcgatctgtcggtcgcgaactacaaccagacgctcatcaacgcgctgaacgacgtcgcgacgcaagtcgcgtcgattcgctcggtcgacacgcaaatgggcgacgcgcagcgcgcgctcgatgcgtcgacgcgcgcctacgagctcgcggtgatccgctacaaggcgggcctgtcgccgcagttgcaggtgctcaacgcggacagcaaccggctcgccgccgagcagacggtgacgaacctgaagatgcgccgccgcgacctgcagatcggcctcgtgaaggcgctcggcggcggcttcgacgcggccggcacgcggctcgccgcgcccgcccccgcctcggcgccggccgcgcccgcgcagcacgcatcgaactga

SEQ ID NO: 98 - DNA, 2337 bp, Burkholderia pseudomallei
tcacagcgaccatttcaactctccataaaaagtgcggcccggataaggatggaacacgtagtagcggcgatcggtcacgttgtcgatgccgaacgacgcaagccagtgccgatcgaaccgatagcgcgccttcaggtcgacgaccatgaacgagctggtgccgccgtatacgcccggattcacgtcgctgttgtcgagcgcgttgtactgccgccccgaatagcgaacgccgacgctcgtcatccaatgctcgtcgaagcggtacgacgcgagcaggttcgcgcgcatccgcggaatccgcggccagcgcgcgccgacgtagttcggattggccgcatcggcaagcgtctgcgcattcgtcgcggacacgttcgcgtcgacgtcgagccccttgagcgcgacgtcctgccccgagaacgcgagctcgacgccgcgcacccgcacgcggtcgacgttcgagacgttcgtgtacgtcgacgcgccggcaagcgtggtctggctgtagatcgaattgcgcagatcgctctggaacacgctcgcgcgcacgacgccgaagccgacgtcgcgctcggcggtgaaatcccagtcgatcgccttttccggctgcagattcgggttgttgttgacgatcgcgttgttcgagatcgtgccctggaacagctcggcgaccgtcggaaagcgcgtgcccgtcgcgaacgacaaccgcaggcgccacgcgctggccggctgccattcgagcgagagcttcggcgagaacgcggtcgcgccgcgctccgcgtagccgagcgtcgcggtcgcgccgccgagctcgccgccgtatgcatcccagcgctcgtagcgcaggccgagcgtcgcgagccagccgggcgcgacgcgccacgcgtcctgcgcatacagcgcctgcgtgcgcgtgttgccgcgatagcggttcacgagcgtcgtcggcaccgcgttttgccagtcggccgtgttgtaggtcgcgttgcgcaggaaatacgtatcgaagtggtagccgaacgaaaaacggtgcccgcgcacgtcgggcgactccgcgcgcaagtcgacggtgcgccagccggtgccgtcgccatggaacaccgtgcccggcccgccgtcccaggcgccgggcggtgcgccggacgcgctgcgcagcacgtcgcgcgacacttcgtaggcggacgcggtggccgacagcttccagccggacgcgagccgcgcgtcgagcccgagcccgtacagccagttctcctggtcgcccgtctgcggcgcgaacgcgcccggcgacaccgtgtagttgcgcccgccgaacgacacgttgccgccgtacaccgggttgcccgccgcgtcgcgcaggaacgtgtcgccgtgctgccggtagtgattctcccagtggccgagcgtgaccgtcgcgtcgacgtgatcggtgaacgcgtagccgaagcgcaacgtctcgttgagctgctcggtgcgctcgatcgtctgcgcgccgacgatcgtccgcggccggccgttcggcccgatgtcggagacggcccccgtcaccggcacgggtgcgccgagcctcggatcgaacgcgccgttcgggctcgcgtattgcatcggctggctgtcgttctcgagccggtcgagcgacagcgcataccagaaacgtccgacgcgatcggcgatgcgcgcgctctggtgattgccgccgaagctgtcggcgaagccgtagccgtcgcgatagcgctgcgtgaagaactgcgtcgacaccgacgcctcgagccgctgcggcttgtgcgtggtgatctgcacggtcgagccgatcgcgttgcccgggtagagcgcggaaaacgggccgtacagcacgtccacgcgtgcgatgtcgtcgggctggatcagcgaccagcgcggcggatacgaatagctggaaccgagcagattggacagcaggatgccgtccgcatagacgagtccgcgcgcgctctgcagctcattgaagtctcggccggcgaacactgaattgcggtcgccgatgtagcgccggcgcaccatcaggttcggcgcgtacttgagcgcgtcttcggtcgtcacgttgacgtgcgaatcgatctgctcgcgcgtgagcgcctcgacgacgccgggcgcgtcgggcgcgaacgcggcgcgctgcgcggtgaccttgacggtatccaaggttttcccggatgcggtcatctccgcggcggcggccggcgttgaatcggcaggcacggcggcggccgtcgaagccgcgtgggcggcgggccaggcgagcgccgcggcgcaggcggccgcgagccgcctgcgcgcgccgggcgcggcaagttgatgaaacat

SEQ ID NO: 99 - DNA, 2097 bp, Burkholderia pseudomallei
tcagaatgtcgtgcgcatcccgatgctcacgctgcgcccgccctgcggcgcgatgttgcgcaccaccgagctcgcgtagcggatgtcctggttcgtcaggttgtcgccgcgcagataggcgagccagttcgtcgcgccgacgcgcaacttgtaggtgagcacgacgccgagcgacgtgtagccgtcggtcgcgagatcgtgctcgggcacgcgatgctgcgcccacgcatgcgtgagctgcgcgcgcgcaccgaacgggccgtagccgtaatcggccgcgagcgtcgcgcgcagcggcgcgatccgcggcagcggctcgcccgtgtccgcgttgcgcgcgtgcgtgtagtcggcgctcagctcgagatcgacgcgatgcccgcgccgctcgaacgcgcgccacctgccttcgagctcgacgccgtagaactccgcgcgcacgccgcgatagacggcctcgcgcagcgcgtcgtcggcgcccggggccacgggcacgccgtcgtcgtcgacgagccgtccggtgtcgtattcggcgaggtagttccgcaggcggctgtagaacacgccgatgctgccgcggttcggaccgctcgcatagcgcagcgcgagatcggtcgacaccgccttctccttctgcgcatcgggccggccgatcaggtactgccccgtcgcgccgtgcgggccgttcgcgtacagctcgtagaaggtcggcgcgcgctccgtgtacgacacgttgcccgcgagcgaccacgcgggcgcgagctgatacagcgcgcccgccgacacgctgcccgcattgaaatcgcgcgagcgcgcgaagccgaacttgtcgtcgccgttcgcgctcggatcgagccgcacgtgctcgatgcgcgcgccggcggacagcttcagcgcgtcggtcgcctgccactgctcgaggccgaacagcgcgacgctcgtcgtgcgcgtggtaggcgcgagcgcctcgccgccgagcgcggagaacgtgttctgtccgacctgcacgccgagcgcgccttcgaacgggccgagcttgcggtgccgcgcctcgacgcgcgcctcgtagccgtgattgcgaaacgtcgtgcccgtcacgccgtcctcgatttccttatgctggtaattcgtgtagccgaagtcgaatttcagctgcgagaacggcccgcgcagattgcgcacctccgacgcgagcgcgacgcgctcctgccgcatctgaagccgcgcgtcggtttcggcgacggagccgtagttcgattcgtagccgctgtacgatgcgccgacgtagccgtccgcccacgtgtacgagccgcccgccgcgccgccgtaacggcggccgtcgctgttcggcagcttgccgtacggctcgctggcgtcctcgccgtcgagcgcgcgctggcgcgccgaatgcgcatggcccggaatccgcagcgcgtcggtctcgcggccgaacgcgtcgagatgaaacgcgaagcggccgttgccgccttcgacgagcgccgcgcccgcacgcgcattgttcgcgccgccgtagctcgcgtcgagcgcgcccgagacgcccgtgatcgcttcgcgcggaatccggttgtcgatcgtgttgacgacgccgccgaccgcgttgccgccgtacagcaacgccgccggcccgcgcacgatctcgatgcgctcgacgctcagcggatcctgcggcaccgcgtgatcgtaggacagcgacgacgcgtcgtacgcggcgacgccgttctgcaggaggcggatgcgatcgccgtccatcccgcggatgatcggacggccgacgagcgggccataggtcgtcgtggacacgccgggcaggccgttcagcgtgtcgccgagcgaatcggtgcggcgcagcgtcagcgcgtcgccggacagcgacgcggtgggcgagctcagcgccgacgcgccgagcgggttcgcggtcacgaagatcggcgcgagcgccgtcgcgggcggcgcgtccgatcggcgctcggcgggcggcgcgcccgtctcgccatgcgcgaggctcgcggcgagcagcagcgacaagggatgcagcctgcgagcgaaaggcggcgcgatacgtcggtggtcatccat

SEQ ID NO: 100 - DNA, 1263 bp, Burkholderia pseudomallei
atgcgcgtcgaacgggttccataccgcttaatcactgtcgcgacggctgccgttttcctggccgcgtgcggaaaaaaagaatcggctccgccccctcaaacgcccgaagtcggcgtcgtcaccgtccagccgcagcccgtgccggtcgtctccgaactgccgggccgtacgagcgcctatctggtcgcgcaggtgcgcgcacgggtcgacggcatcgtgttgcggcgcgagttcacggaaggcagcgacgtcaaggccggccagcgcctgtacaagatcgatccggcaccctatatcgcgcaattgaacagcgcgaaggcgacgctcgcgaaggcgcaggcgaacctcgcgacgcagaacgcgctcgtcgcgcgctacaaggtgctcgtcgccgcgaacgcggtcagcaagcagcagtacgacgatgcggtggccgcgcaagggcaggcggccgccgacgtgggcgcgggcaaggccgccgtcgagaccgcgcagatcaacctcggctatacggatgtcgtctcgccgatcacgggccgcgtcggcatctcgcaggtcacgccgggcgcgtacgtgcaggcgagccaggcgacgctgatgtcgaccgtccagcagctcgatccggtctacgtcgatctcacgcagtcgagcctcgacggcctgaagctgcgccaggacatccagagcgggcgcatcaagacggaaggcccgggcgcggcgaaggtcacgctgattctcgaggacggcaagccgtacccggagcggggcaagctgcagttcagcgatgtcacggtcgaccagacgacgggctcggtcacgatccgcgcgatcttcccgaacaagcagcgcgtgctgctgccgggcatgttcgtgcgcgcgcgcatcgaagagggcgtcaacgagaacgcgttcctcgttccgcagatcggcgtcacgcacgatccgaagggccaggcgatcgcgatgatcgtcgacggcaagggcaaggtcgagccgcgcgtgctggtcacgggcggcacgcagggccagaactgggtggtcgagagcggcctgcaggcgggcgaccgcgtgatcgtgcagggcatcgacaaggtgcgcccgggcatgaccgtgaaggccgccgaggctcaactgccggccgcggcggccggcgcgtcgggtgccgcgcccgcgggcggctcgcccgcccaggccgcggcggcgagcgcggccgcgtcgggtgccgcgccgtcgagcgctgccgccgcgtcgagcgcgcaataa

SEQ ID NO: 101 - protein, 752 aa, Burkholderia mallei
MKVRPSRPLCNLEQRKMEWATSTRVRAIAAGVAFYAAAAGHAQAQAAQPGADARQPGGEAKADTAAGGTLPAISVSGAAERDASVGLVARRSMTGTKTDTPIIEIPQTINVVTAQQIEATGATDINQAFRYIPGFSSYGSDNRSDWYAALRGFTPTVFVDGLQVPNTINLSSWRVDPYMIDSIAVLRGPTSVLYGQGDPGAIVDVQSKLANGERIRELGVQVGNYARKQLMFDIGDTIGKDGTLSYRIVGVGRDGNAQTGPLADQRVSFAPSLKWQPNADTSLTLAATYLQDWGDTSSNFLPSRGTVLPNPNGTISDDLYTADANFDHYRKKQWSLGYQFEHKLNPVWTLRQNVRWMHLSLDDASVYGGGLDDADPTMATMTRYAGLFQFNYSRFDVDNQAQAKFTTGPLSHTLLFGFDYNRQTTTDSEWLAKGPSLNLYRPVYTPIPSDIFSGPNASRTDTKTTLNAFGLYVQDQIKWRRWVLTLGGRQDWTRTSQDDIANAASFRQNDHAFSGRVGLTYLGDYGLAPYLSYSTSFNPQIGLKLAGGGLATPTKGRQIEAGLRWQPPGKNLMLNAAVYQINQTNVAMSNPNDPTSSTFVQVGEVRSRGVELSAVGNLSRELSVIAAYVYQDVKNVRANDNTLNKWPVDVPRPRQIASLWADWTWRTGPLTGFGVGAGVRYMSAAAGAVDNSLTVPSYTLFDAALHYELRNWRFALNATNLFNRRYVAGCQSDAVCMYGNQRTVIATAKYNW

SEQ ID NO: 102 - protein, 510 aa, Burkholderia mallei
MNKTNINERIARVAKIAAASGLLVALLAACAVGPDYRRPDVATPAAFKEAPALAPGEQAGTWKAAEPADAAHRGEWWRVFGDPVLDALETQALAANQNLKAAAARVEQARAATRAARSQWFPQVGVGFGPTREGLSSASQFQPQGSGPTNATLWRAQGTVSYEADLFGRVGRNVEASRADEAQSQALFRSVQLALQADVAQNYFELRRLDSDQDLYRRTVGLREEALKLVQRRFAEGDISELDVSRAKNELATAQADAVGVARRRAASEHALAILLGKAPADFSFSETPIAPVAVRVPAGLPSALLERRPDIAAAERAMMAANARIGLAKSAYFPKLDITGAFGYEAATLGNLFLWSSRTFLLGPFAGTALTLPIFDGGRRSAGVAQARAKYDEEVANYRQQVLVAFREVEDNLADLRLLDDQIRAQSDAVNASRRAAKLSRTQYQEGAVSYLDVIDSERSVLESQLQSNQLTGTQAVSTVNLIRALGGGWGSDAALGSREPGKQDVAAR

SEQ ID NO: 103 - protein, 767 aa, Burkholderia mallei
MARRPLRAALFGAFGLYAAAARAAGPASEPAAAAPPAAASAASAASTSQVRHAAIAAARKDAPALDPITVTATRTASAASRTAASVSVITDSDLEEQQADNIKDALRYEPGVTVRRTAYRPANAALGGGRDGDSSINIRGLEGNRVLLMEDGIRLPSAFSFGPLEAGRGDYADLDTLARIEILRGPASALYGSDGLTGAVNFITKDPSDLLSIHRKKTYFSFRPSYDSVDRSIGATVTAAGGNDRVQAMLIASGRRGHELDTHGDDNSASTRRTRANPQDVYTESLLGKLTITPTARDTIKLAAETVRRRIDTNVLSAINPPTTLGLTANDRLERNRFSIDYDLRDAAARGFQTAHVQFYYQESTQDQDAFETRGGRLQSRSRSNHYSERALGGSAFAESGFATGPLAHKLLYGVDGSIDRIKSLREGTVASPGESFPNKAFPDTDYSLFGAFVQDQIGFGKLLVTPGLRFDAYRLSPSSGDPLFTGKTVSSSDHELSPRVAMLYEASPALIPYAQYAHGFRTPTPDQVNNSFSNPIYGYTSIGNPNLKPETSDTLEAGLRGTLGTGYGPLRYSVAAFAGRYRNFISQRTVGGSGRPNDPLVFQYVNFANARIHGFEGRAEWVMPNGFTLKTAMAFTKGTTQDNGAASEPLDTVNPFSAVFGVRYEPSERWFAQADLLWQAGKRGRDVSSAACQKKTCFTPPSSFVVDLRGGYRFNKHVSAYLGIHNLFDRKYWNWSDVRGIAADSNVLDAYTAPGRSVAVSMKVDF

SEQ ID NO: 104 - protein, 756 aa, Burkholderia mallei
MSRAPHAPSRRRAFGRGFAAAARAAHGAPVAHGAHACFAAASRRATAVERCVTALACAVTASGALAAEAEPADAARGPHRELPTVRVTSDGVHASPLSTPLAAGSRLKLASLDTPASVEVITSAQIAARGDRTIVDAVTRATGFSTAAAPGNGGTALSVRGFAGQESVTTLVDGVRLYPGAGTVTFPFSTWSAERIEVLRGPASVLYGEGAIGGVANVVTRRPRRERSTTLQAGIGTQGEKRVALDTTGALGARLSYRFHLSDERTRGFVERGDAHVTAVGGALKLDVDSRLSITLDYDYGRQKPATYFGVPATNGVLERALRERNYNVGDATIAYHDTWTRLAATYRAGNGVTLDAQLYYLATRRHWRNAESYALDPAARTVARSDYLEIFHRERQFGERFTARIDSRVFGRANRLVLGAEFNQIAFDGANNAPYRGESTVAAAGFDPGAFASPDPTLPRFRTRTHQAAAFIENRLEVLPRLAWVSGLRYDHLSFHRDDLIAGGAFDKTFAHTGWRSGLVYEIAPGLAAYAQYTTGAQGVGSLVTLSASQANYTLATGRQWEAGIKHEIDGARAYWTLAVYDIVKRGLVSVDPLNPARAQQIGRQSSRGVELAGGVRLPGGVTVDANAALLRARYDAFDQRVGDTVVQRAGNVPHDIAQQSANLWIGWAFAPGWRANAGLRYVGPRYGDDANRVPVPSYTVFDASLAWRATRDADLVLYARNLANRTYAASTLNGGAQWLLGPSRSAELVATLRF

SEQ ID NO: 105 - protein, 745 aa, Burkholderia mallei
MTSTFLRHAPAAREGHARRRRRAITLTVPALAAGAFHLAPAVAQTSEAVHGHGTLGASGVASRAETDAASAKSDGAVREAASRTATGAAPDATTLPTIEIVAAPESTPLVVVTDPKTPRQPLPASDGADYLKTIPGFASIRSGGTNGDPVLRGMFGSRLNILANGMPTLGACPGRMDAPTSYIASESYDKVTLVKGPQTVLYGPSASAGTVLFERVTPRFKTPGMRFDGSVVGGSFGRNDQNVDVTAGTPDFYGRVSANHAHSQDYEDGNGRTVPSQWDKWNADAALGWTPDDNTRLELTAGTGDGYARYAGRGMDGAHFRRETFGLKFDKKHIGDVLDRIEAQVFYNEADHVMDNYTLRMPDPTSSMPMRMASEVRRRTLGARVAATLRLTDAFKLVTGVDAQSNRLDSRSAMGMQNYGDKPWNPQANMWNAGAFGELTWYASDASRVIGGARIDYAAARDKRATTGGMKMSMRNPTFDDLRSRVLPSGFVRYERDLASLPVTWYAGIGHAQRFPDYWELFSAKRGPNGSINAFSAIKPEKTTQLDIGAQYKSDKLDAWVSAYAGYVQDFILFDYATGPMGQITRATNVNAQIMGGEVGASWRPLAPWRFEGSLAYAWGRNVQSGAPLPQMPPLEARFGVEYTRGPWSAGGLWRVVAPQHRYALNEGNVVGKDFGPSAGFGVLSLHAQYNVSKTVQISVGVDNVLDKTYAEHLNLAGNAGFGYPANLPVTEPGRTAWVRLSTKL

SEQ ID NO: 106 - protein, 921 aa, Burkholderia mallei
MRTRAACLIEIFSPGLSCFRCSRDMGNEGCIPPIVNESSIMDSICNRRPRRAHAGVCADTAHAPAGLPEAAQPAARLGAGRPRDAAAPRCARQATSHTSHASHTLHAPCMPQFAPRRVVARVAAAALFSACAAPGVSGAAEPAAATRGYDIPAGPLDAALTRFGREAGILLSFPGELTTGLRSPGLHGRADPAAALDRLLTGTGLVALRQPSGGYTLARLPGPAAAGADAALAADTTLPTVAVRASGPHADSYRPPREAAGLRSDAPLAEVPQAVAIVAQQVLRDQRPRNLDDALANVSGITQGNTLGSTQDTVMKRGFGDNRDGSVMRNGMPIVQGRSLNATTDSVEVLKGPASLLYGIMDPGGVINVVTKQPQLARRHAISALGSTYGGGRNGGELTFDSTGAIGESRVAYRLIVDQTNEQYWRNYGEHRETLVAPSLAWYGRDTQVVLSYEYRRFLMPFDRGTALDPRTNAPLAIPARRRLDEPFNDMRGESNLAQLAIDHQLAPDWKVHVGYSYNRETYDANQIRITAVDPLKGTLTRSNDATHGSRSTDSYGIAYVDGRVTLAGMRHDVQFGVDGEYRQVYRADMLRQPIKTPFSYLNPTYGLVPPSTSVSASDSDQSDTLHTASLFFQDSIHLSERWMLVGGARWVRYSQLAGRGRPFQVNTNLSGTKWLPRAGIVYKWNDALSLYGSYTQSLKPTSKIAPMAGGYVIDGSTAPEEGASWELGAKLDMPGGLAGTLAFFDIDKKHVLVSQYDDATNQTAWRTSGRARSRGIELDVSGRIGARWNVIASYAYIDAKTTEDPLYADNRLWNVARHTASLAAVYDVGTVLGGDDLRIGAAGRYVGARPGDSANSFTLPAYATADAFATYDTRLGKQKLQFQLNVKNLFNRTYYPSSVNRFFVSVGDARQVSLLTTLQF

SEQ ID NO: 107 - protein, 215 aa, Burkholderia mallei; identical to SEQ ID NO: 59

SEQ ID NO: 108 - protein, 170 aa, Burkholderia mallei; identical to SEQ ID NO: 60

SEQ ID NO: 109 - protein, 179 aa, Burkholderia mallei
MNGTNELCWRDAFWTPATANAKCDGALVAQAPAPAPVAPVAPAITSQKITYQADTLFDFDKAVLKPAGKQKLDELAAKIQGMNVEVVVATGYTDRIGSDKYNDRLSLRRAQAVKSYLVSKGVPANKVYTEGKGKRNPVTGNTCKQKNRKQLIACLAPDRRVEVEVVGTQEVQKTTVPAQ

SEQ ID NO: 110 - protein, 384 aa, Burkholderia mallei; identical to SEQ ID NO: 63

SEQ ID NO: 111 - protein, 376 aa, Burkholderia mallei
MNKTLIVAAVAASFATVAHAQSSVTLYGVLDAGITYQSNVATPSGSGKSLWSVGAGVDQSRFGLRGSEDLGGGLKAIFTLESGFNIGNGRFNNGGGMFNRQAFVGLSSNYGTVTLGRQYDATQDYLSPLSATGTWGGTYFAHPLNNDRLNTNGDVAVNNTVKFTSANYAGLQFGGTYSFSNNSQFANNRAYSAGASYQFQGLKVGAAYSQANNAGANTTGATDPLTGFNIGGTNAASIQGRSRVYGAGASYAYGPLQGGLLWTQSRLDNLANGAPTIRADNYEANVKYNLTPALGLGVAYTYTYTNAKANGESTHWNQVGVQADYALSKRTDVYAQAVYQRSSKNANASIYNGDLSTPFSTSINQTAATVGLRHRF

SEQ ID NO: 112 - protein, 384 aa, Burkholderia mallei
MKKLALSTLSLALLGAAGAAQAQSSVTLYGVIDTSITYVHGNDGKANNAWLMGSGNLQGSRWGLKGTEDLGAGLKAIFQLENGFNSNDGTLGQGKRMFGRQAFVGLQHDQYGTLTLGRQYDPLVDLVQPVTADNYFGSLFATPGDVDNNDNSLRVNNTVKYTSPVFAGFQFEALYGFSGIAGSPGQGQTWSAAAAYNNGPIGVAAGYFYTSNPSPTAGSRSTWSGSSDAIFDGAINSGYTSAKSIGIAQVAGQYVFGPVTVGLGYSNAQYKPDGFSGFSSTEKYNTGRGFVRYQATPALLLGLGYAYTKASGDTDAKYHQVSIGADYALSKRTDVYLAGAYQHASGTQRVDATTTQTAQASIGSYGVNGTKSQEMVALGLRHKF

SEQ ID NO: 113 - protein, 514 aa, Burkholderia mallei
MKRKHALTALAVALLAAGCTLAPRYERPAAPVSGAFPADGVYAAQPGAAPGARSANGQAAVDIGWREFFVDPRLQRLIEIALKNNRDLRVSVLNVEASRAQYQITRAGLFPTLSGTGTGTIQRTPAGVSITGQPLISRTYNVGVSASWELDLFGRVQSLKDQALAQYFATAQARKAAEISLVASVADQYLTLLSTDDLLQVTQNTLKSARASYDLTKLQFDNGTGSELDLCQAQTVVETALASQQAQARARAQALNALVLLIGEPLPDDLPADLPLNAQNLLTDIPAGLPSDLLTRRPDIMQAEETLRAANANIGAARAAFFPKISLTSAFGTASTTLGGLFKAGTAAWSFAPNIALPIFEGGQNIANLDLAHVQKRIEIANYEKAIQSAFREVSDGLAARGTYDQQIAALERNEHAQQRRYDLSDLRYRNGVDSYLSVLTAQTDLYSAQQQLISARLARWTNLVDLYRALGGGWLERAGETPRPADAPVDYGKAAPAPAAAVPAASASAPAAG

SEQ ID NO: 114 - protein, 158 aa, Burkholderia mallei; identical to SEQ ID NO: 68

SEQ ID NO: 115 - protein, 79 aa, Burkholderia mallei; identical to SEQ ID NO: 69

SEQ ID NO: 116 - protein, 306 aa, Burkholderia mallei
MLNFLVKRLFGLLPTLACVAVLVFLFVHLLPGDPARLAAGPEADDATVALVRADLGLDKPLPAQFASFFARIAHGDFGVSTRSKRPVATEIGERFMPTLTLTVVSMAWATLFGMAIGIASAVWRNRWPDRIGMTLAVSGISFPAFALGMLLMEVFSVKLGWLPVVPDGSWKSYVLPSVTLGAAVAAVMARFTRASFVEVLNKDFVRTARAKGVREPMVVLKHCLRNAMIPVVTMMGLQFGFLLGGSIVVEAVFNWPGLGRLLVDAVTMRDYPVIQAIVLLFSLEFILINLSVDVLYAVINPTIRFK

SEQ ID NO: 117 - protein, 498 aa, Burkholderia mallei
MKTFPLSACRTAVAVAVAALALAGCANYFGLKNDKAIAPAAQFESARSLPAQGGQWPSLDWANQFGDPQLPKLIDEALEGNPTIAQAQARIAKASSYIESSRSTLLPKADAKYSWTRELYSGNALFPPPYGGQWYSENNALASASWELDLWGKNRARLNAAVSQEKAAEADLQQARVTLATSVARTYNQLAQLYALRDIAGREISNRQTVDKITDGRVGAGLDTNVERQTARGNIATSQSTLSDLDGQITNVRYQLAALLGKGPDRGLQIAAPVLSAGGAVALPENLPADLVSRRPDLVAARWQVEAAMHDVKEAKAEFFPDINLAAGFGFDAFGWGRFLNFASRQAQFGPAIHLPIFDGGALRAQLKGRYADFDLSVANYNQTLINALNDVATQVASIRSVDTQMGDAQRALDASTRAYELAVIRYKAGLSPQLQVLNADSNRLAAEQTVTNLKMRRRDLQIGLVKALGGGFDAAGTRLAAPAPASAPAAPAQHASN

SEQ ID NO: 118 - protein, 778 aa, Burkholderia mallei
MFHQLAAPGARRRLAAACAAALAWPAAHAASTAAAVPADSTPAAAAEMTASGKTLDTVKVTAQRAAFAPDTPGVVEALTREQIDSHVNVTTEDALKYAPNLMVRRRYIGDRNSVFAGRDFNELQSARGLVYADGILLSNLLGSSYSYPPRWSLIQPDDIARVDVLYGPFSALYPGNAIGSTVQITTHKPQRLEASVSTQFFTQRYRDGYGFADSFGGNHQSARIADRVGRFWYALSLDRLENDSQPMQYASPNGAFDPRLGAPVPVTGAVSDIGPNGRPRTIVGAQTIERTEQLNETLRFGYAFTDHVDATVTLGHWENHYRQHGDTFLRDAAGNPVYGGNVSFGGRNYTVSPGAFAPQTGDQENWLYGLGLDARLASGWKLSAIASAYEVSRDVLRSASGAPPGAWDGGPGTVFHGDGTGWRTVDLRAESPDVRGHRFSFGYHFDTYFLRNATYNTADWQNAVPTTLVNRYRGNTRTQALYAQDAWRVAPDWLATLGLRYERWDAYGGELGGATATLGYAERGATAFSPKLSLEWQPASAWRLRLSFATGTRFPTVAELFQGTISNNAIVNNNPNLQPEKAIDWDFTAERDVGFGVVRASVFQSDLRNSIYSQTTLAGASTYTNVSNVDRVRVRGVELAFSGQDVALKGLDVDANVSATNAQTLADAANPNYVGARWPRIPRMRANLLASYRFDEHWMTSVGVRYSGRQYNALDNSDVNPGVYGGTSSFMVVDLKARYRFDRHWLASFGIDNVTDRRYYVFHPYPGRTFYGELKWSL

SEQ ID NO: 119 - protein, 751 aa, Burkholderia mallei
MAPAATRAPSRRIDALPHGPSCALILIRYIVSCSSRDSARDSVHPDHTTPITAMDDHRRIAPPFARRLHPLSLLLAASLAHGETGAPPAERRSDAPPATALAPIFVTANPLGASALSSPTASLSGDALTLRRTDSLGDTLNGLPGVSTTTYGPLVGRPIIRGMDGDRIRLLQNGVAAYDASSLSYDHAVPQDPLSVERIEIVRGPAALLYGGNAVGGVVNTIDNRIPREAITGVSGALDASYGGANNARAGAALVEGGNGRFAFHLDAFGRETDALRIPGHAHSARQRALDGEDASEPYGRLPNSDGRRYGGAAGGSYTWADGYVGASYSGYESNYGSVAETDARLQMRQERVALASEVRNLRGPFSQLKFDFGYTNYQHKEIEDGVTGTTFRNHGYEARVEARHRKLGPFEGALGVQVGQNTFSALGGEALAPTTRTTSVALFGLEQWQATDALKLSAGARIEHVRLDPSANGDDKFGFARSRDFNAGSVSAGALYQLAPAWSLAGNVSYTERAPTFYELYANGPHGATGQYLIGRPDAQKEKAVSTDLALRYASGPNRGSIGVFYSRLRNYLAEYDTGRLVDDDGVPVAPGADDALREAVYRGVRAEFYGVELEGRWRAFERRGHRVDLELSADYTHARNADTGEPLPRIAPLRATLAADYGYGPFGARAQLTHAWAQHRVPEHDLATDGYTSLGVVLTYKLRVGATNWLAYLRGDNLTNQDIRYASSVVRNIAPQGGRSVSIGMRTTF

SEQ ID NO: 120 - protein, 420 aa, Burkholderia mallei; identical to SEQ ID NO: 75

SEQ ID NO: 121 - DNA, 2259 bp, Burkholderia mallei
ttaccagttgtatttcgcggtcgcgatcacggtgcgctggttgccgtacatgcacaccgcatccgactggcagccggccacgtagcggcggttgaacaggttcgtcgcgttgagcgcgaaacgccagttgcgcagctcgtagtgcagcgccgcgtcgaacagcgtgtagctcggcaccgtgagcgaattgtcgaccgcgcccgccgccgcgctcatgtagcgcacgcccgcgccgacgccgaagcccgtgagcggcccggtgcgccacgtccagtcggcccacagcgacgcgatctggcgcggccgcggcacgtcgacgggccacttgttcagcgtgttgtcgttcgcccgcacgttcttcacgtcctgatagacgtacgcggcgatcaccgacagctcgcgcgacaggttgcccaccgcgctcagctcgacgccgcgcgagcgcacctcgcccacctgcacgaacgtgctgctcgtcgggtcgttcggattgctcatcgcgacgttcgtctggttgatctggtagacggccgcgttcagcatcaggttcttgccgggcggctgccagcgcaggcccgcctcgatctggcggcccttggtcggcgtcgcgagcccgccgcccgcgagcttcaggccgatctgcggattgaacgacgtcgaatagctgaggtacggcgcgagcccgtagtcgccgagatacgtgaggcccacgcgcccgctgaacgcgtggtcgttctgcctgaagctcgccgcgttcgcgatgtcgtcctgcgacgtgcgcgtccagtcctgccggccgccgagcgtgagcacccagcgccgccacttgatctggtcctgcacgtacaggccgaatgcgttcagcgtcgtcttcgtgtcggtgcgcgacgcgttcggcccgctgaagatgtcggacggaatcggcgtgtagacgggccggtacaggttcaggctcggccccttcgcgagccattcgctatcggtcgtcgtctggcggttgtagtcgaagccgaacagcagcgtgtgcgaaagcgggcccgtcgtgaatttcgcctgcgcctggttgtcgacgtcgaagcggctgtagttgaactggaacaggcccgcgtagcgcgtcatcgtcgccatcgtcgggtctgcgtcgtcgaggccgccgccgtagacggacgcgtcgtcgagcgacaggtgcatccagcgcacgttctgccgcagcgtccacaccgggttcagcttgtgctcgaactgatagccgagcgaccactgcttcttgcggtaatggtcgaagttcgcatcggccgtgtacaggtcgtccgagatcgtgccgttcggattcggcagcacggtgccgcgcgacggcaggaagttgctcgacgtgtccccccagtcctgcaggtacgtcgcggcgagggtgagcgacgtgtccgcgttcggctgccatttgagcgacggcgcgaacgacacgcgctggtcggcgagcggccccgtctgcgcgttgccgtcgcggccgacgccgacgatccggtacgacagcgtgccgtccttgccgatcgtgtcgccgatgtcgaacatcagttgcttgcgcgcgtagttgccgacctgcacgccgagctcgcggatgcgctcgccgttcgcgagcttgctctgcacgtcgacgatcgcgccgggatcgccctgcccgtacagcaccgacgtcgggccgcgcagcacggcgatgctgtcgatcatgtacggatcgacgcgccagctcgacaggttgatcgtgttcggcacctgcagcccgtcgacgaacacggtcggcgtgaagccgcgcagcgccgcgtaccagtccgaacggttgtccgacccgtagctcgagaagcccggaatgtagcggaacgcctgattgatgtcggtcgcgcccgtcgcctcgatctgctgcgcggtgacgacgttgatcgtctgtggaatctcgatgatcggcgtatccgttttcgtgcccgtcatgctgcgccgcgcgacgaggccgacgctcgcgtcgcgctccgctgctcccgacaccgagatcgcgggcaacgtgccgcccgccgcggtgtctgccttcgcctcgccgcccggctgccgcgcgtccgcccccggctgcgccgcctgtgcctgcgcatgacccgccgccgccgcgtagaacgccacgccggccgcgatcgcacgcacgcgcgtgctggttgcccactccatcttccgttgctccaagttgcaaagcggccgcgagggccgcaccttcat

SEQ ID NO: 122 - DNA, 1533 bp, Burkholderia mallei
atgaacaagaccaacatcaacgaacgcatcgcgcgcgtcgcgaagatcgcggcggcgagcgggttgctcgtcgcgctgctcgccgcgtgcgcggtggggcccgactaccggcggcccgatgtcgcgacgcccgcggcgttcaaggaagcgccggcgctcgcgccgggcgagcaggccggcacgtggaaggcggccgagccggccgacgccgcgcatcgcggcgaatggtggcgcgtattcggcgatccggtgctcgatgcgctcgaaacgcaggcgcttgccgcgaaccagaacctgaaggccgcggcggcgcgcgtcgagcaggcgcgcgcggcgacccgcgccgcgcgctcgcagtggttcccgcaagtgggcgtgggcttcgggccgacgcgcgaggggctgtcgtcggcgtcgcagttccagccgcagggcagcggcccgacgaacgcgacgctctggcgcgcgcagggcacggtgtcgtacgaagcggacctgttcggccgcgtcggccgcaacgtcgaagcgtcgcgcgcggacgaagcgcagagccaggcgctgttccgctcggtgcagctcgcgttgcaggcggacgtcgcgcagaactacttcgagctgcgccggctcgattccgaccaggatctgtaccggcgcacggtcgggctgcgcgaggaggcgctcaagctcgtgcagcggcgctttgccgaaggcgacatcagcgagctcgacgtgtcgcgcgcgaagaacgaactggcgaccgcgcaggcggacgcggtgggcgtcgcgcggcggcgcgccgcatcggagcatgcgctcgcgatcctgctcggcaaggcgcccgcggatttctcgttcagcgagacgccgatcgcgccggtggcggtgcgcgtgccggcggggctgccgtcggcattgctcgagaggcggcccgacatcgcggcggccgagcgcgcgatgatggccgcgaacgcgcgcatcggcctcgcgaagtccgcgtacttcccgaagctcgacatcaccggcgcgttcggctatgaggcggcgacgctcggcaacctgttcctgtggtcgagccgcacgttcctgctcgggccgttcgcgggcacggcgctcacgctgccgatcttcgacggcgggcgccgcagcgcgggcgtcgcgcaggcgcgcgcgaagtatgacgaggaagtcgcgaactaccggcagcaggtgctcgtcgcgttccgcgaagtggaggacaaccttgccgatctgcgtctgctcgacgatcagatccgcgcgcaaagcgacgccgtcaacgcgtcgcggcgcgcggcgaagctgtcgcgcacgcagtatcaggaaggcgcggtcagctatctcgacgtgatcgacagcgagcgctcggtgctcgaatcgcaactgcaatcgaaccagttgacgggcacgcaggcggtatcgacggtcaacctgattcgcgcgctcggcggcggctgggggagcgatgcggcgctcggctcgcgcgagccgggcaagcaggacgtcgcggcgcgttga

SEQ ID NO: 123 - DNA, 2304 bp, Burkholderia mallei
ttggcgcggcggccgcttcgcgccgcgctgttcggggccttcggcctctatgcggcggccgcgcgcgccgccggccccgcttccgaacccgcggccgccgcgccgccggccgccgcatccgccgcatccgccgcatccacgtcgcaggtgcggcacgcggcgatcgccgccgcgcgcaaggacgcgccggcactcgatccgatcaccgtcaccgcgacgcgcaccgcgtcggccgcgagccgcaccgcggcgagcgtatcggtgatcaccgattcagacctcgaggagcagcaggccgacaacatcaaggacgcgctgcgctacgagccgggcgtcaccgtgcgacgcaccgcgtaccgcccggcgaacgccgcgctcggcggcggccgcgacggcgattcgagcatcaacatccgcggcctcgaaggcaaccgcgtgctgctgatggaagacggcatccggctgccgagcgcgttctcgttcggcccgctcgaagccggccgcggcgattacgccgatctcgacacgctcgcgcgcatcgagatcctgcgcggtccggcgtccgcgctgtatggcagcgacggcctgacgggcgccgtcaacttcatcacgaaagatccgtccgatctgctgtcgatccatcgaaaaaagacctatttctcgttccggccgagctacgactcggtcgaccgcagcatcggcgcgaccgtgacggcggcgggcggcaacgatcgcgtgcaggcgatgctgatcgcgtccggccgccgcggccacgaactcgacacgcacggcgacgacaattccgcgagcacgcggcgcacgcgcgcgaatcctcaggatgtctacacggaatcgctgctcggcaagctgacgatcacgccgaccgcgcgcgacacgatcaagctcgccgccgaaacggtgcggcggcggatcgacacgaacgtgctgtcggcgatcaatccgccgacaacgctcggcctcaccgcgaacgacaggctcgagcgcaaccgcttcagtatcgactacgatttgcgcgacgccgccgcgcgcgggttccagaccgcgcacgtgcagttctactatcaggagtcgacgcaggatcaggacgcgttcgagacgcgcggcgggcggctccaatcgcgttcgcgctcgaaccactacagcgagcgcgcgctcggcggctccgcgttcgccgagagcggcttcgcgaccgggccgctcgcgcacaagctgctgtacggcgtcgacggcagcatcgaccgcatcaagagcctgcgcgagggcaccgtcgcgagccccggcgaatcgttcccgaacaaggcgtttccggacaccgactactcgctgttcggcgcgttcgtgcaggatcagatcggcttcggcaagctgctcgtcacgccgggcctgcgcttcgacgcgtatcggctcagcccgagctcgggcgatccgctgttcaccggcaagacggtcagctcgagcgatcacgagctgtcgccgcgcgtcgcgatgctctatgaagcgtcgcccgcgctgattccctacgcgcagtatgcgcacggctttcgcacgccgacgcccgatcaggtcaacaacagcttctcgaatccgatctatggctatacatcgatcggcaatccgaacctgaagcccgagacgagcgacacgctcgaagcgggcctgcgcggcacgctcggcaccggctacgggccgctgcgctacagcgtcgccgcgttcgccggccgctatcgcaacttcatctcgcagcgcacggtaggcggcagtggccggccgaacgatccgctcgtgttccagtacgtaaacttcgcgaacgcgcgcattcacggcttcgagggacgcgccgaatgggtgatgccgaatggcttcacgctgaagacggcgatggcgttcacgaagggcacgacgcaggacaacggcgcggcgagcgagccgctcgatacggtcaacccgttctccgccgtgttcggcgtgcgctacgagccgagcgagcgctggttcgcgcaggcggacctgctgtggcaggcgggcaagcgcggccgcgacgtgtcgtcggccgcgtgccagaaaaagacctgcttcacgccgccgtcgtcgttcgtcgtcgatctgcgcggcggctaccgcttcaacaagcacgtgagcgcctacctcggcattcacaacctgttcgaccgcaagtactggaactggtcggacgtgcgcggcatcgccgccgattcgaacgtgctcgacgcatacaccgccccgggccgcagcgtcgcggtcagcatgaaggtggatttctga

SEQ ID NO: 124 - DNA, 2271 bp, Burkholderia mallei
atgagccgggcgccgcatgcaccgtcgcgccgtcgcgcgttcgggcgcgggttcgcggcggctgctcgcgccgctcacggcgcgcctgtcgcgcatggcgcgcacgcgtgcttcgccgccgcgtcgcgtcgcgcgacggccgtcgagcgctgcgtcaccgcgctcgcgtgcgcggtgacggcgtccggcgcgctcgccgccgaggcggaaccggccgacgccgcgcgcggcccgcatcgcgaactgccgaccgtgcgcgtgacgagcgacggggtgcacgcgtcgccgctgtctacgccgctcgcggccggctcgcgcctgaagctcgcgagcctcgacacgcccgcgagcgtcgaggtgatcacctccgcgcagatcgccgcgcgcggcgatcgcacgatcgtcgacgccgtcacgcgcgcgacgggcttcagcacggccgcggcgcccggcaacggcggcacggcgctcagcgtgcgcggcttcgccggccaggaatcggtgacgacgcttgtcgacggcgtgcgcctctaccccggcgcgggcaccgtcacgttcccgttctcgacgtggtccgccgagcgcatcgaggtgctgcgcgggccggcgtcggtgctgtacggcgaaggggcgatcggcggcgtcgccaacgtcgtgacccggcgcccgcgccgcgaacgctcgacgacgctgcaggcgggcatcggcacgcaaggcgaaaagcgcgtggcgctcgatacgacgggcgcgctcggcgcgcgtctttcctatcgtttccatctgagcgacgagcgcacgcgcggcttcgtcgagcgcggcgacgcgcacgtgacggccgtcggcggcgcgctgaagctcgatgtcgattcgcgtctgtcgatcacgctcgattacgactacggccgccagaagccggcgacctatttcggcgtgccggcgacgaacggcgtgctcgagcgcgcgctgcgcgagcgcaactacaacgtcggcgacgcgacgatcgcataccacgacacctggacgcggcttgccgcgacctatcgcgcgggcaacggcgtgacgctcgatgcccagctctactatctcgcgacgcgccgccattggcgcaacgcggaatcgtatgcgctcgacccggcggcgcgcaccgtcgcgcgcagcgactatctcgagatcttccatcgcgagcggcagttcggcgagcgcttcaccgcacgcatcgactcgcgcgtgttcggccgcgcgaaccggctcgtgctcggcgccgagttcaaccagatcgcgttcgacggcgcgaacaacgcgccgtatcgcggcgaatcgaccgtcgccgccgccggcttcgatcccggcgcgttcgcgagccccgatccgacgctgccgcgctttcgcacgcgcacgcatcaggccgcggcgttcatcgagaaccggctcgaggtcctgccgcggctcgcgtgggtgagcgggctgcgttacgaccatctgtcgtttcatcgcgacgatctgatcgcgggcggcgcgttcgacaagacgttcgcgcacaccggctggcgcagcgggctcgtctacgagatcgcgccgggcctcgccgcgtacgcgcagtacacgacgggtgcgcagggcgtgggctcgctcgtcacgctgtcggcgtcgcaggcgaactacacgctcgcgaccgggcgtcaatgggaagcgggcatcaagcacgagatcgacggcgctcgcgcgtactggacgctcgccgtctacgacatcgtcaagcgcggcctcgtcagcgtcgatccgctgaatccggcgcgcgcgcagcagatcggccgccagtcgtcgcgcggcgtcgagctcgcgggcggcgtgcggctgccgggcggtgtgacggtcgacgcaaacgcggcgttgctgcgcgcgcgctacgacgcgttcgaccagcgcgtcggcgacacggtcgtgcagcgcgccggcaacgtgccgcacgacatcgcgcagcagagcgcgaacctgtggatcggctgggcgttcgcgcccggctggcgcgcgaacgcgggcctgcgctacgtcggtccccgctacggcgacgacgcgaaccgcgtgccggtgccttcttacacggtgttcgacgcgtcgctcgcgtggcgggcgacgcgcgacgccgacctcgtgctctatgcgcgcaacctcgcgaaccgcacgtacgcggcgtcgacgttgaacggcggcgcgcaatggctgctcggcccgtcgcgctcggccgagctcgtcgcgacgctgcgcttctag

SEQ ID NO: 125 - DNA, 2238 bp, Burkholderia mallei
atgacatccacattcctgcgtcacgcgcccgccgcgcgtgaaggccacgcgcgccgccggcggcgcgcgatcacgcttaccgttcccgcgctcgccgcgggcgcctttcacctcgcgccggccgtcgcgcagacgagcgaggccgtgcacggccacggcacgctcggcgcgtccggcgtagcgagccgcgccgagaccgacgcggcgagcgccaaatcggacggcgcggttcgcgaagcggcgagccgcacggcaaccggcgccgcgccggacgccacgacgctgccgacgatcgaaatcgtcgcggcgcccgaatcgacgccgctcgtcgtcgtcaccgatccgaagacgccgcgccagccgctgcccgcgagcgacggcgccgattatctgaagacgattcccggcttcgcgtcgatccgcagcggcggcacgaacggcgacccggtgctgcgcgggatgttcggctcgcggctgaacattctcgcgaacggcatgccgacgctcggtgcgtgtcccggccggatggacgcgccgacgtcgtacatcgcgtccgagagctacgacaaggtgacgctcgtcaaggggccgcagaccgtgctgtacgggccgagcgcatcggcgggcacggtgctgttcgagcgcgtgacgccgcgcttcaagacgccgggcatgcgctttgacggcagcgtcgtcggcggctcgttcgggcgcaacgatcagaacgtcgacgtgacggccggcacgcccgacttctacgggcgcgtgagcgcgaaccatgcgcactcgcaggactacgaggacggcaacggccgcacggtgccgtcgcaatgggacaagtggaacgcggatgcggcgctcggctggacgcccgacgacaacacgcggctcgagctgacggcaggcacgggcgacggctacgcgcgctatgcgggccgcggaatggacggcgcgcatttccggcgcgagacgttcggtctgaagttcgacaagaagcacatcggcgacgtgctcgatcgcatcgaggcgcaggtcttctacaacgaagccgatcacgtgatggacaactacacgttgcggatgcccgatccgacgagcagcatgccgatgcgcatggcctccgaagtgcgccgccgcacgctcggcgcgcgcgtcgcggcgacgctgcgcttgaccgacgcgttcaagctcgtgacgggcgtcgatgcgcagtcgaaccgcctcgactcgcgctcggcgatggggatgcagaactacggcgacaagccgtggaatccgcaggcgaacatgtggaacgcgggcgcgttcggcgagctgacctggtatgcgagcgatgcgtcgcgcgtgatcggcggcgcgcggatcgactatgcggccgcgcgcgacaagcgcgcgacgacgggcggcatgaagatgagcatgcgcaatccgacgttcgacgatctccgctcgcgcgtgctgccgagcggcttcgtgcgctacgagcgtgatctcgcgtcgctgcccgtcacgtggtacgcgggcatcggccatgcgcagcgcttccctgattactgggagctgttctccgccaagcgcggcccgaacggttcgatcaacgcgttctccgcgatcaagcccgagaagacgacgcagctcgacatcggcgcgcagtacaagagcgacaagctcgacgcctgggtgtccgcctatgcgggctacgtgcaggacttcatcctgttcgactatgcgacgggcccgatgggacagatcacgcgggcgacgaacgtcaacgcgcagatcatgggcggtgaggtgggcgcgtcgtggcgtccgctcgcgccgtggcgcttcgaagggtcgctcgcgtatgcgtgggggcgcaacgtgcaaagcggtgcgccgctgccgcagatgccgccgctcgaggcacgcttcggcgtcgagtacactcgcgggccgtggtcggcgggcgggctgtggcgggtcgttgcgccgcagcatcgctacgcgctgaacgagggcaacgtcgtcggcaaggacttcggtccgagcgccggtttcggcgtgctgtcgctgcacgcgcagtacaacgtgagcaagacggtgcagatctcggtcggcgtcgacaacgtgctcgacaagacttatgcggagcacctgaacctcgcgggcaacgccggtttcggctatccggcgaatctgcctgtcaccgaacccggccgcaccgcgtgggttcgtttgagcaccaagctctga

SEQ ID NO: 126 - DNA, 2766 bp, Burkholderia mallei
tcagaactgcagcgtcgtcagcagcgacacctgccgcgcgtcgcccaccgacacgaagaaccggttcacgctcgacgggtaatacgtgcggttgaacagattcttcacgttgagctggaactgcagcttctgcttgccgagccgcgtgtcgtaggtcgcgaacgcgtcggcggtcgcgtacgccggcagcgtgaagctgttggccgaatcgcccgggcgcgcgccgacgtagcgccccgccgcgccgatgcgcaggtcgtcgccgccgagcaccgtgcccacgtcgtagaccgccgcgagcgaggccgtgtgccgcgcgacgttccacagccggttgtccgcgtacagcggatcttcggtcgtcttcgcgtcgatgtacgcgtagctcgcgatcacgttccaacgcgcaccgatccgccccgacacgtcgagctcgatcccgcgcgagcgcgcgcggccggacgtgcgccacgcggtctggttcgtcgcgtcgtcgtattgcgagacgagcacgtgcttcttgtcgatgtcgaagaacgcgagcgtaccggcgaggccgcccggcatgtcgagcttcgcgccgagctcccacgacgcgccttcctcgggcgcggtcgagccgtcgatcacgtagccgcccgccatcggcgcgatcttcgaggtcggcttcagcgactgcgtgtagctgccgtacagcgacagcgcgtcgttccacttgtagacgatgcccgcgcgcggcagccacttcgtgccgctcaggttcgtgttgacctggaacggccggccgcgcccggcaagctggctgtagcggacccagcgcgcgccgccgacgagcatccaccgctcgctcagatggatgctgtcctggaagaacagcgaggcggtgtgcagcgtgtcgctctggtcgctgtcggaggccgatacgctcgtcgacggcgggacgagcccgtacgtcgggttcagatagctgaacggcgtcttgatcggctggcgcagcatgtccgcgcggtagacctgccggtattcgccgtcgacgccgaactgcacgtcgtgccgcatcccggcgagcgtcacgcggccgtcgacgtacgcgatgccgtagctgtcggtgctgcgcgaaccgtgcgtcgcgtcgttgctgcgcgtgagcgtgcccttgagcggatcgaccgccgtgatgcgaatctggttcgcatcgtaggtctcccggttgtagctgtagccgacgtgcaccttccagtccggcgcgagctgatgatcgatcgcgagctgcgcgagattcgattcgccgcgcatgtcgttgaacggctcgtcgagccggcggcgcgccgggatcgcgagcggcgcgttcgtgcgcggatcgagcgcggtgccgcgatcgaacggcatcaggaagcgccggtactcgtacgacagcaccacctgcgtatcgcgcccgtaccacgcgagcgaaggcgcgacgagcgtctcgcggtgctcgccgtagttgcgccaatactgttcgttcgtctgatcgacgatcagccggtatgcaacgcgcgactcgccgatcgcgcccgtcgagtcgaacgtgagctcgccgccgttcctgccgccgccgtacgtcgagccgagcgccgagatcgcgtggcggcgcgcgagctgcggctgcttcgtgacgacgttgatcacgccgcccgggtccatgattccgtacagcagcgaggccgggcccttcagcacttcgacgctgtccgtcgtcgcgttcagcgagcggccctgcacgatcggcattccgttgcgcatcaccgagccgtcgcggttgtcgccgaagccgcgcttcatcaccgtgtcctgcgtgctgccgagcgtgttgccctgcgtgatgccgctcacgttcgcaagcgcgtcgtcgagattgcgcgggcgctggtcgcgcagcacctgctgcgcgacgatggcgaccgcttgcggcacctcggcgagcggcgcgtcgctgcgcagccccgccgcctcgcgcggcggccggtagctgtccgcgtgcgggccgctcgcgcgcacggcgacggtgggcagcgtcgtgtcggccgcgagcgcggcatcggcgccggcggcggccggcccgggcagcctggcgagcgtgtagccgccgctcggctgccggagcgcgacgagccccgtgcccgtcagcagccggtcgagcgccgcggccggatccgcgcggccgtgcagcccggggcttcgcaggcccgtggtcagctcgcccgggaacgacagcaggatgccggcctcgcggccgaagcgggtcagcgccgcgtcgagcgggcccgccggaatgtcgtacccgcgcgtcgcggcggccggctcggccgcgcccgatacgcccggcgcggcgcacgcggagaacagcgcggcggcggccacgcgcgcgacgacgcggcgcggggcgaattgcggcatgcacggcgcgtgcaacgtgtgcgacgcgtgcgatgtgtgcgatgtggcttgccgcgcgcatcgcggcgcggccgcgtcgcgcggccggcctgcgccgagccgcgcggcgggctgagccgcctcgggcaaaccggccggcgcgtgcgccgtatccgcgcacacgccggcgtgcgcgcggcgggggcggcgattgcagattgaatccatgatcgatgactcgttgacgatgggtggaatgcagccttcatttcccatgtcacgcgagcatcgaaaacagctcaggcccggcgaaaaaatttcgatgaggcatgcggcgcgcgtgcgcaa

SEQ ID NO: 127 - DNA, 648 bp, Burkholderia mallei; identical to SEQ ID NO: 84

SEQ ID NO: 128 - DNA, 513 bp, Burkholderia mallei
ttactgttgatagacgaggtccgcacggcggttctgcgcccacgacgcttcgtcgtggccgagcgcaaccggcttttccttgccgagactcacggcttccatctgcgcatccccgacgccgagcagcgacagcgcgcggcgcacggcttccgcacgcttttggccgagcgcgaggttgtactcgctcgtgccgcgctcgtcggtgttgccctggatcaggatgtggcgttgcggatggctcttcaggtattgcgcgtgttgctgcagcagcgcctggtattggtcctgcaccgagtagctgtcgaaatcgaagtacacgctgcgcttcgcgagcgggctgttcggatcgttcagcggatcgacggtcacctgcgcgacgttttcgggattcggttgcgtgctgaccgcgtcgccctggttcgcgtgctcgtcgagcttcacgcccgacttgcatgccgcgagcgcgccgatcatcagcatcgcgaacgccagacgaagtttcttcgacatcat

SEQ ID NO: 129 - DNA, 540 bp, Burkholderia mallei
atgaacggcacgaacgagctctgctggcgcgatgcgttctggacgccggccaccgccaacgccaagtgcgatggcgcactggtcgcccaggcaccggcaccggcgccggtcgcaccggttgctccggccatcacgagccagaagattacgtaccaagccgatacgctgttcgacttcgacaaggccgtcctgaagccggccggcaagcagaagcttgacgaactggccgcgaagatccagggcatgaacgtcgaagtggtcgtggccacgggctacacggaccgcatcggttcggacaagtacaacgaccgtctgtcgctgcgccgcgcgcaagccgtcaagtcgtacctcgtcagcaagggtgtcccggcgaacaaggtctacacggaaggcaagggcaagcgcaacccggtcacgggcaacacctgcaagcagaagaaccgcaagcagctcatcgcctgcctcgcaccggaccgccgcgtggaagtcgaagtggtcggcacgcaggaagtgcagaagacgaccgttccggcgcagtaa

SEQ ID NO: 130 - DNA, 1155 bp, Burkholderia mallei
tcagaacttgtgacggatcgccgcgcgaaccgcgaactggttcgccgacgccgaggggccgtccgtcccgacgacgtagccgccatccgcgatcgtgcccgtcttgtcgcccgcgaccttctggtacgcgccctgcagatagacgtcggtgcgcttcgacaggttgtagtccgccatcaggccgaccgtgtggtacttcggcttgacgctgcccgcggccgcatcgaacttgccgtccgtgtacacgtactgcgcgccgatgaagagcgccggcgtcagctggtatttgccgttgatttcgaagttctggaacttcgtcgcgctcaggccgaggcccgcgaacgtcgccgtcggcagatagaccgtcgagaccgggttcttcacgtcggtcttcgtgtagacgaaaccgaccgtcgccgggccgaacgtgtagttgacgccgccgccgaagatgcgcaggcggtccgccgtgaagttcgcgtcgttgtcggcgatcgcgccgcccgccgtcttgcccgggttgttcgcctgcaggtacgcggccgcgagttgcaggccgcccagcgtgtacgcggcgccgatgctgtactggcggttgttcgagaagcccgtcgcgttgctgaagctgtacgtgccgccgacttgcagaccgttccagtccgggctcgcgtacttgaccgtgttgttcacgcggaacgagttgtccgtgttgtcgttgtcgaacggatgcgagaacagcgtgccgccccagttgccgttcgcggtcaacggcgcgaggtagtcgacgagcgaatcgtactggcggccgagcgtgagcgagccgtattgcgcgtgcgacaggccgacgaacgcctggcggccgaacatccggccgccctggccgagccggccgttgttcacgtcgaaaccgttttcgagcgtgaagatggctttcaggccgccgcccaggtcttccgagccgcgcaggccccagcggctgccctgcacgaaaccgctcgcgagctggtagttgctcttgccgacgccgttgacgttcacgttgctcgtgtagttgaagccttcgtcgatcacgccgtacagcgtgacgctgctttgggcgaaaaccggcgcggcgaaggccagcaatgcggctgcggaaatgacgtgctttttcat

SEQ ID NO: 131 - DNA, 1131 bp, Burkholderia mallei
ttagaagcggtgacgcagaccaaccgtcgctgcggtttggttgatcgacgtgctgaacggcgtgctgaggtcgccgttgtagatcgacgcattcgcgttcttcgacgaacgctggtacacggcttgtgcgtacacgtcggtgcgcttcgacagcgcgtagtcggcctggacgccaacttggttccagtgagtgctttcgccgttcgccttcgcgttcgtgtacgtgtacgtgtaagcaacacccagacccagagccggcgtcaggttgtacttcacgtttgcttcgtagttgtcggcacggatggtcggcgcgccgtttgccaggttgtcgagacgcgattgcgtccagagcaggccgccttgcagcgggccgtaagcgtagcttgcaccggcgccgtacacgcgcgagcggccttggatgcttgctgcgttcgtgccgccgatgttgaagccggtcagcggatccgttgcgcccgtggtgttcgcgccagcgttgttagcttgcgagtacgccgcaccgaccttcaggccttggaactggtacgaagcgcccgcgctgtatgcacggttgttcgcgaattgcgagttgttcgagaacgagtacgtgccgccgaattgcaggccggcgtagttcgcgctcgtgaacttgaccgtgttgttcaccgcgacgtcgccgttcgtgttcaggcggtcgttgttgagcgggtgcgcgaagtacgtgccgccccaggtgcccgttgccgacagcggcgacaggtagtcttgggttgcgtcgtactgacggcccagcgtgacggtgccgtagttgctcgacagaccgacgaacgcttgacggttgaacatgccgccaccgttgttgaagcggccgttaccgatgttgaagccgctttccaacgtgaagatcgccttcaggccgccacccaggtcttccgagccgcgcagaccgaaacggctttggtcgacgccggcgccgaccgaccacagcgacttgcccgagcccgacggcgtcgcgacgttgctttggtacgtgatgcccgcgtcgagcacaccgtacagcgtgacgctgctttgcgcgtgcgcgacggttgcgaacgatgcagcaactgctgcaacaatcagagtcttgttcat

SEQ ID NO: 132 - DNA, 1155 bp, Burkholderia mallei
ttagaacttgtggcgcaggcccagagccaccatctcttgcgacttcgtaccgttcacgccgtacgagccgatcgatgcctgcgccgtttgcgtcgtcgtcgcgtcgacgcgctgcgtgccgctcgcgtgctggtacgcaccggcgaggtagacgtccgtgcgcttggacagcgcgtagtccgcgccgatcgacacttggtggtacttcgcgtccgtgtcgccgctcgccttcgtgtatgcgtagccgaggccgagcagcagcgccggcgtggcctggtacctcacgaagccgcggcccgtgttgtacttctcggtcgacgagaagcccgagaagccgtccggcttgtattgcgcgttgctgtagccgaggccgaccgtgaccgggccgaacacgtactggccggccacctgtgcgatgccgatcgacttcgcgctcgtgtagccgctgttgatcgcgccgtcgaagatcgcgtcggacgagccgctccacgtcgagcgcgagccggccgtcggcgacgggttcgacgtgtagaagtagccggccgcgacgccgatcgggccgttgttgtatgcggcggcggccgaccacgtctggccttggcccggcgagcccgcgatgccgctgaagccgtacagggcttcgaactggaagccggcgaacacgggcgacgtgtacttgaccgtgttgttcacgcgcaggctgttgtcgttgttgtcgacgtcacccggggtggcgaacaggctgccgaagtagttgtcggccgtcaccggttgcacgaggtcgacgagcggatcgtactgacggccgagcgtcagcgtgccgtactggtcatgctgcagaccgacgaacgcctggcggccgaacatgcgcttgccttggccgagcgtgccgtcgttcgagttgaagccattttccaactggaagatcgccttcaggccggcgccgagatcctcggtgcccttcaggccccagcggctgccttgcaggttgccgctgcccatcagccaggcgttgttggccttgccgtcgttgccgtggacataagtgatcgacgtatcaatcacgccgtacagcgtgacgctgctttgagcctgagctgcaccggctgcgcccagcagcgcgagcgagagggtagacagagcgagtttcttcat

SEQ ID NO: 133 - DNA, 1545 bp, Burkholderia mallei
atgaagcgaaaacatgctttgactgcactcgcagtcgcgctgctcgccgcgggctgcacgctcgcgccgcgctacgagcgtccggccgcgccggtgtcgggcgcgttccccgccgacggcgtctatgccgcgcagccgggcgccgcgcccggcgcgcgcagcgcgaacggccaggcggccgtcgatatcggctggcgcgagttcttcgtcgatccgcgcctgcagcggctgatcgagatcgcgctgaagaacaaccgcgacctgcgcgtgtcggtgctcaacgtcgaagcgtcgcgcgcgcagtatcagatcacgcgcgcggggctcttcccgacgttgagcggcaccggcacgggcacgatccagcgcacgccggccggcgtgtcgatcaccggccagccgctcatctcgcggacctacaacgtcggcgtctccgcgtcgtgggagctcgacctgttcggccgcgtgcagagcctgaaggaccaggcgctcgcgcaatacttcgccaccgcgcaggcgcgcaaggccgcggagatctcgctcgtcgcgagcgtcgccgatcagtacctgacgctgctgtcgaccgacgatctgctgcaggtcacgcagaacacgctgaagtcggcgcgcgcgtcctacgatctgacgaagctgcagttcgacaacggcaccggctcggagctcgacctgtgccaggcgcagacggtggtcgagaccgcgctcgcgagccagcaggcgcaggcgcgcgcccgcgcgcaggcgctcaacgcgctcgtgctgctgatcggcgagccgctgcccgacgatctgccggccgacctgccactcaatgcgcagaacctgctcaccgacattccggccgggctgccgtccgatctgctcacgcggcggcccgacatcatgcaagccgaggagacgctgcgcgcggcgaacgcgaacatcggcgcggcgcgcgcggcgttcttcccgaagatctcgctcaccagcgcgttcggcaccgcgagcacgacgctcggcggcctgttcaaggcgggcacggcggcgtggtcgttcgcgccgaacatcgcgctgccgatcttcgagggcgggcagaacatcgcgaacctcgatctcgcgcacgtgcagaagcgcatcgagatcgcgaactacgagaaggcgatccagagcgcgtttcgcgaggtgtcggacgggcttgccgcgcgcggcacgtacgatcagcagatcgcggcgctcgagcgcaacgagcacgcgcagcagcgccgctacgatctgtcggacctgcgctacaggaacggcgtcgacagctatctgtcggtgctgaccgcgcagacggacctgtattcggcgcagcagcagttgatcagcgcgcggctcgcgcgctggacgaacctcgtggacctgtatcgcgcgctgggcggcgggtggctcgagcgcgcgggcgagacgccgcgcccggcggacgcgcccgtcgattacggcaaggcggcgcccgcgccggcggcggccgtgccggctgcgtcggccagcgcgccggcggcgggctga

SEQ ID NO: 134 - DNA, 477 bp, Burkholderia mallei
atgcaaggcgacaagaaagtcatcgaatatctgaacgcgcagttgaaaaacgaactgaccgcgatcaatcaatatttcctgcatgcgcggatgtacaaacactggggcctcgaaaaactcggcaagcacgaatacgacgaatcgatcggcgaaatgaagcacgcggactggctgatcgagcgcgtgttcatgctcgacggcctgccgaacctgcaggatctgcacaagctgctcgtcggcgaggaaaccgaggaaatcctgaaatgcgacctgaagctcgaacaggtatcgcaggccacgtgcaaggaagccatcgcttattgcgaatcggtgcgtgattacgtgtcgcgcgaaatcttcgagaaaatcctcgacgataccgaggagcacatcgactggctcgagacgcaaatcgacctgatcggcaaggtcggcattcagaactatcagcagtcgatgatgggctcgccggaataa

SEQ ID NO: 135 - DNA, 240 bp, Burkholderia mallei
atgatcgtctgcgtgtgcaagtccgtttccgatcggaagattcgcgcatccctcgcggaaggcgtgaacacgttcgaagaactccagttcgaactcggggtcgccacctgctgcggcaagtgcgaggaaaccgtgcgcgagatcatggcggaacagggcgtttgtgcgagccgctgcggtgccgagcgccccgcggccgtaccggtcgccgtcacgttctacgaacgcaaggcggcctga

SEQ ID NO: 136 - DNA, 921 bp, Burkholderia mallei
atgctgaattttctggtcaaacgactgttcgggctgctgccgacgctcgcgtgcgtcgcggtgctggtgttcctgttcgtccacctgctgccgggcgatcccgcgcggctcgcggccggccccgaggccgacgacgcgaccgtcgcgctcgtgcgcgccgatctcggcctcgacaagccgctgccggcgcagttcgcgagcttcttcgcgcggatcgcgcacggcgacttcggcgtctcgacgcgcagcaagcggcccgtagcgaccgagatcggcgagcgcttcatgccgacgctgacgctgaccgtcgtcagcatggcctgggcgacgctcttcggcatggcgatcggcatcgcgtcggccgtgtggcgcaaccgctggccggaccgcatcggcatgacgctcgcggtgtcgggcatctcgtttccggcgttcgcgctcggcatgctgctgatggaggtgttctcggtgaagctcggctggctgcccgtcgtgccggacggctcgtggaagagctacgtgctgccgtcggtgacgctcggcgcggccgtggccgccgtgatggcgcgcttcacgcgcgcgtcgttcgtcgaggtgctgaacaaggatttcgtgcgcaccgcgcgcgcgaagggcgtgcgcgagccgatggtcgtgctcaagcactgcctgcgcaacgcgatgattccggtcgtcacgatgatggggctgcagttcggcttcctgctcggcggctcgatcgtcgtcgaggcggtgttcaactggccggggctcgggcgcctgctcgtcgatgcggtgacgatgcgcgactacccggtgatccaggcgatcgtgctgctgttctcgctggagttcatcctgatcaacctgagcgtcgacgtgctgtacgcggtcatcaacccgacgatccgtttcaagtga

SEQ ID NO: 137 - DNA, 1497 bp, Burkholderia mallei
atgaaaaccttcccgttgtccgcttgccggaccgccgtggccgtcgcggtcgccgcgctcgcgctcgcgggatgcgcgaactatttcggcctcaagaacgacaaggcgatcgctcccgcggcgcagttcgaaagcgcgcggagcctgcccgcgcagggcggccaatggccgtcgctcgactgggcgaaccagttcggcgatccgcaattgccgaagctgatcgacgaggcgctcgaaggcaatccgacgatcgcgcaggcgcaggcgcgcatcgcgaaggcgtcgtcgtacatcgagtcgtcgcgctcgacgctgctgccgaaggccgacgcgaagtactcgtggacccgcgagctgtactcgggcaacgctcttttcccgcccccgtacggcggccagtggtacagcgagaacaacgcgctcgcgagcgcgtcgtgggagctcgatctgtggggcaagaaccgcgcgcgcctgaatgcggccgtgtcgcaggaaaaggccgccgaagccgacttgcagcaggcgcgcgtgacgctcgcgacgtcggtcgcgcgcacgtacaaccagctcgcgcaactgtacgcgctgcgcgacatcgccgggcgcgagatctcgaaccggcagacggtcgacaagatcaccgacggccgcgtcggcgcgggcctcgacacgaacgtcgagcgccagaccgcgcgcggcaacatcgcgacgagccagtcgacgctgtccgatctcgacggccagatcacgaacgtccgctatcagctcgccgcgctgctcggcaaaggtccggaccgcgggctgcagatcgccgcgcccgtgctgagcgcgggcggcgcggtcgcgctgccggagaacctgcccgccgatctcgtgtcgcgccgcccggatctcgtcgccgcgcgctggcaggtcgaagcggcgatgcacgacgtgaaggaagcgaaagccgagttctttccggacatcaacctcgcggcgggcttcggcttcgacgcgttcggctggggccgattcctgaacttcgcgagccgccaggcgcagttcggccccgcgatccacctgccgatcttcgacggcggcgcgctgcgcgcgcaattgaagggccgctacgcggacttcgatctgtcggtcgcgaactacaaccagacgctcatcaacgcgctgaacgacgtcgcgacgcaagtcgcgtcgattcgctcggtcgacacgcaaatgggcgacgcgcagcgcgcgctcgatgcgtcgacgcgcgcctacgagctcgcggtgatccgctacaaggcgggcctgtcgccgcagttgcaggtgctcaacgcggacagcaaccggctcgccgccgagcagacggtgacgaacctgaagatgcgccgccgcgacctgcagatcggcctcgtgaaggcgctcggcggcggcttcgacgcggccggcacgcggctcgccgcgcccgcccccgcctcggcgccggccgcgcccgcgcagcacgcatcgaactga

SEQ ID NO: 138 - DNA, 2337 bp, Burkholderia mallei
tcacagcgaccatttcaactctccataaaaagtgcggcccggataaggatggaacacgtagtagcggcgatcggtcacgttgtcgatgccgaacgacgcgagccagtgccgatcgaaccgatagcgcgccttcaggtcgacgaccatgaacgagctggtgccgccgtatacgcccggattcacgtcgctgttgtcgagcgcgttgtactgccgccccgaatagcgaacgccgacgctcgtcatccaatgctcgtcgaagcggtacgacgcgagcaggttcgcgcgcatccgcggaatccgcggccagcgcgcgccgacgtagttcggattggccgcatcggcaagcgtctgcgcattcgtcgcggacacgttcgcgtcgacgtcgagccccttgagcgcgacgtcctgccccgagaacgcgagctcgacgccgcgcacccgcacgcggtcgacgttcgagacgttcgtgtacgtcgacgcgccggcaagcgtggtctggctgtagatcgaattgcgcagatcgctctggaacacgctcgcgcgcacgacgccgaagccgacgtcgcgctcggcggtgaaatcccagtcgatcgccttttccggctgcagattcgggttgttgttgacgatcgcgttgttcgagatcgtgccctggaacagctcggcgaccgtcggaaagcgcgtgcccgtcgcgaacgacaaccgcaggcgccacgcgctggccggctgccattcgagcgagagcttcggcgagaacgcggtcgcgccgcgctccgcgtagccgagcgtcgcggtcgcgccgccgagctcgccgccgtatgcatcccagcgctcgtagcgcaggccgagcgtcgcgagccagtcgggcgcgacgcgccacgcgtcctgcgcatacagcgcctgcgtgcgcgtgttgccgcgatagcggttcacgagcgtcgtcggcaccgcgttttgccagtcggccgtgttgtaggtcgcgttgcgcaggaaatacgtatcgaagtggtagccgaacgagaaacggtgcccgcgcacgtcgggcgactccgcgcgcaagtcgacggtgcgccagccggtgccgtcgccatggaacaccgtgcccggcccgccgtcccaggcgccgggcggtgcgccggacgcgctgcgcagcacgtcgcgcgacacctcgtaggcggacgcgatggccgacagcttccagccggacgcgagccgcgcgtcgagcccgagcccgtacagccagttctcctggtcgcccgtctgcggcgcgaacgcgcccggcgacaccgtgtagttgcgcccgccgaacgacacgttgccgccgtacaccgggttgcccgccgcgtcgcgcaggaacgtgtcgccgtgctgccggtagtgattctcccagtggccgagcgtgaccgtcgcgtcgacgtgatcggtgaacgcgtagccgaagcgcaacgtctcgttgagctgctcggtgcgctcgatcgtctgcgcgccgacgatcgtccgcggccggccgttcggcccgatgtcggagacggcccccgtcaccggcacgggtgcgccgagcctcggatcgaacgcgccgttcgggctcgcgtattgcatcggctggctgtcgttctcgagccggtcgagcgacagcgcataccagaaacgtccgacgcgatcggcgatgcgcgcgctctggtgattgccgccgaagctgtcggcgaagccgtagccgtcgcgatagcgctgcgtgaagaactgcgtcgacaccgacgcctcgagccgctgcggcttgtgcgtggtgatctgcacggtcgagccgatcgcgttgcccgggtagagcgcggaaaacgggccgtacagcacgtccacgcgtgcgatgtcgtcgggctggatcagcgaccagcgcggcggatacgaatagctggaaccgagcagattggacagcaggatgccgtccgcatagacgagtccgcgcgcgctctgcagctcattgaagtctcggccggcgaacactgaattgcggtcgccgatgtagcgccggcgcaccatcaggttcggcgcgtacttgagcgcgtcttcggtcgtcacgttgacgtgcgaatcgatctgctcgcgcgtgagcgcctcgacgacgccgggcgtgtcgggcgcgaacgcggcgcgctgcgcggtgaccttgacggtatccaaggttttcccggatgcggtcatctccgcggcggcggccggcgttgaatcggcaggcacggcggcggccgtcgaagccgcgtgggcggcgggccaggcgagcgccgcggcgcaggcggccgcgagccgcctgcgcgcgccgggcgcggcaagttgatggaacat

SEQ ID NO: 139 - DNA, 2256 bp, Burkholderia mallei
atggcgcccgcggcgacgcgggcgccgagccgtcgtatcgatgcgctgcctcacgggccttcctgtgcgctgatattgatacgttatatcgtttcctgttcatcgcgcgattcggcccgtgattccgtccaccccgaccacaccacaccgattaccgcaatggatgaccaccgacgtatcgcgccgcctttcgctcgcaggctgcatcccttgtcgctgctgctcgccgcgagcctcgcgcatggcgagacgggcgcgccgcccgccgagcgccgatcggacgcgccgcccgcgacggcgctcgcgccgatcttcgtgaccgcgaacccgctcggcgcgtcggcgctgagctcgcccaccgcgtcgctgtccggcgacgcgctgacgctgcgccgcaccgattcgctcggcgacacgctgaacggcctgcccggcgtgtccacgacgacctatggcccgctcgtcggccgtccgatcatccgcgggatggacggcgatcgcatccgcctcctgcagaacggcgtcgccgcgtacgacgcgtcgtcgctgtcctacgatcacgcggtgccgcaggatccgctgagcgtcgagcgcatcgagatcgtgcgcgggccggcggcgttgctgtacggcggcaacgcggtcggcggcgtcgtcaacacgatcgacaaccggattccgcgcgaagcgatcacgggcgtctcgggcgcgctcgacgcgagctacggcggcgcgaacaacgcgcgtgcgggcgcggcgctcgtcgaaggcggcaacggccgcttcgcgtttcatctcgacgcgttcggccgcgagaccgacgcgctgcggattccgggccatgcgcattcggcgcgccagcgcgcgctcgacggcgaggacgccagcgagccgtacggcaggctgccgaacagcgacggccgccgttacggcggcgcggcgggcggctcgtacacgtgggcggacggctacgtcggcgcatcgtacagcggctacgaatcgaactacggctccgtcgccgaaaccgacgcgcggcttcagatgcggcaggagcgcgtcgcgctcgcgtcggaggtgcgcaatctgcgcgggccgttctcgcagctgaaattcgacttcggctacacgaattaccagcataaggaaatcgaggacggcgtgacgggcacgacgtttcgcaatcacggctacgaggcgcgcgtcgaggcgcggcaccgcaagctcggcccgttcgaaggcgcgctcggcgtgcaggtcggacagaacacgttctccgcgctcggcggcgaggcgctcgcgcctaccacgcgcacgacgagcgtcgcgctgttcggcctcgagcagtggcaggcgaccgacgcgctgaagctgtccgccggcgcgcgcatcgagcacgtgcggctcgatccgagcgcgaacggcgacgacaagttcggcttcgcgcgctcgcgcgatttcaatgcgggcagcgtgtcggcgggcgcgctgtaccagctcgcgcccgcgtggtcgctcgcgggcaacgtgtcgtacacggagcgcgcgccgaccttctacgagctgtacgcgaacggcccgcacggcgcgacgggacagtacctgatcggccggcccgatgcgcagaaggagaaggcggtgtcgaccgatctcgcgctgcgctatgcgagcggtccgaaccgtggcagcatcggcgtgttctacagccgcctgcggaactacctcgccgaatacgacaccggacggctcgtcgacgacgacggcgtgcccgtggccccgggcgccgacgacgcgctgcgcgaggccgtctatcgcggcgtgcgcgcggagttctacggcgtcgagctcgaaggcaggtggcgcgcgttcgaacggcgcgggcatcgcgtcgatctcgagctgagcgccgactacacgcacgcgcgcaacgcggacacgggcgagccgctgccgcggatcgcgccgctgcgcgcgacgctcgcggccgattacggctacggcccgttcggtgcgcgcgcgcagctcacgcatgcatgggcgcagcatcgcgtgcccgagcacgatctcgcgaccgacggctacacgtcgctcggcgtcgtgctcacctacaagttgcgcgtcggcgcgacgaactggctcgcctatctgcgcggcgacaacctgacgaaccaggacatccgctacgcgagctcggtggtgcgcaacatcgcgccgcagggcgggcgcagcgtgagcatcgggatgcgcacgacattctga

SEQ ID NO: 140 - DNA, 1263 bp, Burkholderia mallei
atgcgcgtcgaacgggttccataccgcttaatcactgtcgcgacggctgccgttttcctggccgcgtgcggaaaaaaagaatcggctccgccccctcaaacgcccgaagtcggcgtcgtcaccgtccagccgcagcccgtgccggtcgtctccgaactgccgggccgtacgagcgcctatctggtcgcgcaggtgcgcgcacgggtcgacggcatcgtgttgcggcgcgagttcacggaaggcagcgacgtcaaggccggccagcgcctgtacaagatcgatccggcaccctatatcgcgcaattgaacagcgcgaaggcgacgctcgcgaaggcgcaggcgaacctcgcgacgcagaacgcgctcgtcgcgcgctacaaggtgctcgtcgccgcgaacgcggtcagcaagcagcagtacgacgatgcggtggccgcgcaagggcaggcggccgccgacgtgggcgcgggcaaggccgccgtcgagaccgcgcagatcaacctcggctatacggatgtcgtctcgccgatcacgggccgcgtcggcatctcgcaggtcacgccgggcgcgtacgtgcaggcgagccaggcgacgctgatgtcgaccgtccagcagctcgatccggtctacgtcgatctcacgcagtcgagcctcgacggcctgaagctgcgccaggacatccagagcgggcgcatcaagacggaaggcccgggcgcggcgaaggtcacgctgattctcgaggacggcaagccgtacccggagcggggcaagctgcagttcagcgatgtcacggtcgaccagacgacgggctcggtcacgatccgcgcgatcttcccgaacaagcagcgcgtgctgctgccgggcatgttcgtgcgcgcgcgcatcgaagagggcgtcaacgagaacgcgttcctcgttccgcagatcggcgtcacgcacgatccgaagggccaggcgatcgcgatgatcgtcgacggcaagggcaaggtcgagccgcgcgtgctggtcacgggcggcacgcagggccagaactgggtggtcgagagcggcctgcaggcgggcgaccgcgtgatcgtgcagggcatcgacaaggtgcgcccgggcatgaccgtgaaggccgccgaggctcaattgccggccgcggcggccggcgcgtcgggtgccgcgcccgcgggcggctcgcccgcccaggccgcggcggcgagcgcggccgcgtcgggtgccgcgccgtcgagcgctgccgccgcgtcgagcgcgcaataa

SEQ ID NO: 141 - protein, 754 aa, Burkholderia cenocepacia
MKKVEQKKMEWATGTRLRAIAAAASVAFGTAAAGHAYAQTAPAVNAGATASASSAQTGATATTSTSAQNGTLPAITVNAASAGDGTVGLVAKRSTTGTKTDTPLNEIPQTINVVTAQQIEMTGATDVNAALRYVPGFSSYGSDNRSDWYAALRGFTPTAYVNGLQVPNTINLASWRVDPYMIDSISVLRGPTSVLYGAGDPGAIIDVHTKLADGERVREAGVQIGNYARKQFMIDVGDKLDPDGKYAYRFVGVARDGNALTGPNNDQRVALAPSFRWRPDADTSLTLSATYLQDWGDISSNFLPAQGTVLPNPNGQINKDIYEGDGNFNYYRKKQWSVGYQFERNLTPAWTFRQNTRLMHLSLDNGSVFGNGFVEGSTTDVSRWAGVFQMNYSRFDIDNNLEGRFATGPLQHTLLLGFQYNRQTATDSEWLAAAPPLNIYNPVYQPVTTAVFTPDATIRTNTYTTINTFGLYAQDQIKWNRWTLTLGGREDWVNMRMDDRAAGTSTKADVTAFTGRVGLTYQGDYGLSPYVSYATSFNPLIGVNLVGGGLPQPTRGKQIEAGLRWQPPGKNLMLNAAIYQINQTNVLTSALPSQDPTGTKSVQTGEVRSRGIELSATGKVTRNLSVIASYVYQDVKNVQANDVSLNNWPVDIPRPRQMASLWTDWTWYTGPLAGFGLGGGIRYQSASAGAADNSLTVSSVTLFDAGLHYDVRNWRFAVNGTNLFNRHYISGCQSNNVCIFGTDRTVIATAKYNW

SEQ ID NO: 142 - protein, 513 aa, Burkholderia cenocepacia
MNNLHNTNGLMRFAKVAAASTLLATLLAACAVGPDYKRPDAAAPAAFKEAPTLAAGEQAGTWKTAEPADGEHRGEWWKVFGDPVLDSLETQALAANQNLKAAAARVEEARAATRSARSQWFPQVGAGFGPTREGLSSASQFQPQGTGPTNATLWRAQGTVSYEADLFGRVGRNVEASRADQAQSEALFRSVQLALQADVAQNYFELRQLDSDQDLYRRTVELREQALKLVQRRFNEGDISELDVSRAKNELASAQADAVGVARRRAASEHALAILLGKAPADFAFKETPIVPVAVKIPPGLPSALLERRPDVSAAERAMAAANARIGLAKSAYFPKLDITGSFGYEASTLGNLFLWSSRTFLLGPFAGTALTLPLFDGGRRAAGVQQARAQYDEQVANYRQQVLVAFREVEDNLADLRLLDDQIRAQDAAVNASRRAATLSRTQYQEGEVAYLDVIDSERSVLQSQLQANQLTGAQAVSTVNLIRALGGGWGNAPAPTAVGDAASGKADVAAR

SEQ ID NO: 143 - protein, 747 aa, Burkholderia cenocepacia
MKSRPDELKLGKFTTLCSVLAASPAFADGTPPAAPASTEGHLAPIEIQGKTEHSYKADFSASAKFTAPLVDTPKSVTVIPQELIQSSGAATLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFAEHAAFRLNLMSHNNDVAGRDAVNNERWGVAPSIAFGLGTPTRVTASYYHLQTDDMPDGGIPYFYTTSNKPANVGTIYPAPVDRHNFYGLIDRDFRKTTSDISTIKIEHDITPNLTVRNTTRYTESTQDYIWTQPDDSQGNVVNGKVWRRNNNRNSSINSLANLTELFGEFRTGPFKHSFTTGIELSREWGKRDSYTVATDKGTICQKGIGAASGYNCTSLWSPNPNDPWAGSITRNNDYAHARTTTKSIYGFDTIEITPRWQVNAGVRVDDYSTRFTDTKANGGKTYTRDDTLFNWQAGLVFKPAQNGSIYASYATSSTPAGMMLGEGSETQSLTPGRGGVGPNADQLSPEKNRSIELGTKWNVLNDKLSLTAALFQIDTTNARVTLPNNQYAMVSNKRVQGLELGLAGQITKQWQVFGGYTYMKSQLRDNGKDAANNGNRFPNTPKHSLTMWSNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 144 - protein, 755 aa, Burkholderia cenocepacia
MHCYTLARRPICAALFGAFGLSAAPAHADSSPQGAPPPSAVLTAASARGEAALLDPVTVTATRTATAASRTAASVSVITDEDLEEQQATNIKDALRYEPGITVRRTAYRPGSAALGGGRDGDSSINIRGLEGNRVLLMEDGIRLPNAFSFGPLEAGRGDYADLDTLKRIEILRGPASALYGSDGLTGAVNFITKDPRDLLSIYHKPYYFSFRPSYDSTDRSIGATVSAAGGNDRIQGMIIADGRRGHEVDTRGDNNSASTLRTTSNPQDVYSESLLGKLVLTPTTRDTIKFTAETVQRRVSTDVLSAINAPATLGLTTHDRLERNRFSVDYDFRDDAFRWFQTAHVQFYYQDAKQDQYAFETRGRLPSRSRDNQYKERTFGGAAFAESGFSTGPLAHKLLYGVDGSLSRVTNLRDGTVPGVGEAFPNKAFPDTDYTLFGAFVQDQIGYGRLLVTPGLRFDTYRLSPTENDPLFTGKAVSTSANELSPRVAVLYEITPAVIPYVQYAHGFRAPTPDQVNSSFSNPVYGYTSIGNPNLKPETSDTFEAGLRGKAGTGYGVVRYSAAAFTGRYRNFISRTTLAGSGRPVDPFVFQYVNFADARIHGLEGRAEWVMPNGITLKTAMAFTKGSTQNDGAASQPLNTVNPFSAVFGVRYEPTERWFVQTDLLFQAAKRDKDVDKSDCSNKACFTPPSSFVVDLRGGYRFNKHVSATIGIRNLFDRKYWNWSDVRGIAADSQVLDAYSSPGRTVAVSMKVDF

SEQ ID NO: 145 - protein, 738 aa, Burkholderia cenocepacia
MRYEVREPERSMMQGARVARFGRWRPSLYLGLLIAAHPAAAFADAAPAAGAEVRRDKAAAAQPAGSELKAIAVNASRGVADDPSVATVGKMPLALREIPQSVSVTTRERIDQQNLFSLDEVMQQSAGVTVQPYVLLTTAYFVRGFKVDSFEFDGVPVVIGDMASAPQDISVYERVEILRGANGLLHGSGNPAATVNLVRKRPQYQFSAHATASVGSWDRYRAEADIGGPLNAAGTVRSRLVAAYEDRHFFYDHAKQDTRSIYSVTEVDVTRDTLLTFGAQYQTTTSVPDMSGVPMARDGSSLGLSRSTFLDTAWGRFNWDTTRAFASIEQKLGAGWKAKVSGEYQSVRSDLKYAGSFGAIDPATGAGGRLTGAAYQFSSYSRSIDANVQGPVHAFGLTHDLLFGVTYANSSSGQMTAPLLGDVAGTPVNVYRWNPSSVPEPGIGPYQQSQQNDVSQKGVYGLGRIKLAEPLTLVLGGRMSWWNQDSLGAHYNTGHQFTPYGGLIWDFARDWSWYASYAEVFQPQTKSMWGGGILTPVKGRTYETGVKGELAGGKLDVSLAAFRIDLDNNPQVDLAHPCAGPSCYYVNGGSVRSQGFEFEANGRITPWWSVWASYTYDTMRYADNLANAGSFAPLLNPRHLFRLWTNYDLPWQERRWSIGGGVQVQSSYSAQANGVTMSQGGYALASVRLGYRYDKHWSAALNVNNLFDRTYYLSLSQPGWNNRYGEPRNVMLTVRGQF

SEQ ID NO: 146 - protein, 696 aa, Burkholderia cenocepacia
MATTGALAAEAAASAPDDRHALPAINVTASSAPADPLTQPLETGSRLGLASLDTPASVETVTADTIDARGDRTVLDAVTRTAGFASAIAPGTGGTALSVRGFSGQESVMTLLDGVRLMPAAGTITFPFDTWSVARIEVLRGPASVLYGEGAIGGVVNVVPKRPQRTRETTLQAGVGPDGAKRFAFDTTGALGPRLSYRFYASDARANGLAERADTHTTAIGGALTFDVSPQLTLTLDYDYGRQMPATYYGVPAPHGVLDPSLRKLNYTVGDATISYYDQWTRLSASYRPAPGVTISNQLYYLTSNRHWRNAESYVLDLATGRVTRGDYLDIGHHQRQIGDRLSARFDGMLFGRANRFVVGTEFSQITFSGTNNSPYGGETTVPAHGFDPGVFTSPDPTVPQFSTRARQAAVFAENRLEVLPRLAWVSGLRYDHIAFSREQAATGAGFDKRFANVGWRTGVVFDIAPAFTAYAQYTTGAEGVGSLVTLSASQMNVRLATGEQWEAGLKQTLLDGRAYWTVAVYDITKRNLLSTDPFNPALRQQVGRQSSRGVDLTGGARLSHGWTIDANVALLRARYDAFNQTVGGATVSRAGNVPSGVPQQTANLWLGWAFAERWHVNAGVRYVGATYGDDANRVRVPSYTVFDASLRWQPTSRTELALYLRNLANRTYAVTTSNGGEQWLLGPSRSAELVATMRF

SEQ ID NO: 147 - protein, 710 aa, Burkholderia cenocepacia
MTNFLLRAPRAPRNAGARPLPRVLKLTVPALAVGALAASAAAAETTPAAGAPSGDAAMLLPPVEVVASPLSTPLVVVTDPKAPRQPLPASDGADYLKTIPGFTSIRSGGTNGDPVLRGMFGSRLNILANGMPTLGACPNRMDAPTSYIAPESYDKVTVVKGPQTVLYGPGASAGTVLFERVTPRFERPGMRFDGSLVGGSFGRNDQNIDLTAGTPDIYGRVTANHAHSQDYKDGNGNTVPSQWDKWNADAALGWTPDDHTRLELTAGTGDGYARYAGRGMDGAHFRRETFGLSFDKRHLGDVLDRIEARVYYNEADHVMDNYTLRQPDPTSSMPMRMAADVRRRTVGARAAATFRFGDDFKLVTGVDAQSNRLDSRASMGQQNYRDQPWDAQATMWSAGVFSELTWYASDVSRVIGGARVDYASARDKRAMKSGMMMSKPNPTFDDDRTKVLPSGFVRYERDLASLPVTWYAGIGHAERYPDYWELFSATRGPAGSINAFSAVQPEKTTQLDIGAQYKSDRFDAWVSAYAGYVQDFILFNYAAGMMGPITQATNVNAQIMGGEAGVSWRPVAPLRVETSLAYAWGRNVASGDPLPQMPPLEARIGLEYTRGAWSAGGLWRIVAPQHRYALNEGNVVGKDFGPSAGFGVLSLHTQYNVSKTVQISVGVDNVLNKAYTEHLNLAGNAGFGYPANAPVMEPGRTAWVRVSAKL

SEQ ID NO: 148 - protein, 855 aa, Burkholderia cenocepacia
MGNESSPSPSSTDSPIMASIRLTYQRRPAPARHLPRASRPAASGRLARRLAGAVLLSALLPLPALADTDADAAPATQRASRRAFDIPAGPLEAALNRFGRDAGILLAFPPELTAGLASGGVHGRFDVDGAFDRLLAGTGLVALRQPGGGYTLMRADGSAAGPVAAGVAPAAELPTIDVRSSALRAESYRAPKEAGVLRSDIPLLDTAQAVNIVPAQVLRDQRPRNLDDALGNVSGITQGNTLAGTQDTIMKRGFGGNRDGSIMQNGMPLVQGRAFNAATDSVEVLKGPTSLLYGLMDPGGVVNVVTKQPQLVRYNVISLGASTFGHGKNGGSATFDSTGPVGDSRLAYRLIVDQSNEQYWRNFGEYRQTFVAPSLAWYGRDTQVAVSYQYRKFHSPFDRGTALDPRTNAPLDIPARRRIDEPFNNMDGESQLAQLSVDHQFNADWSAHFGYSYNRETYDANQLRTTGVDPVKGTMTRSNDATHGSLSTDSYGIGYVTGKLTLAGMRHDVQVGFDTEYRRIYRKDLLRQAVKTPFSYIDPVYGLLPPSSTVSASDSDQTDTLHDASAFFQDTVHLTDKWIVSGGLRYITYNQVAGRGRPFVANTDLSGSKWLPRAGVVYKWTDAFSLYGSYSQSLKPSSSIAPMTGYIIDGATPPEEATAWEVGGKLGLAGGMTGTLALFNIDKKNVLVSQYNDATKLTDWRTSGKARSRGVELDVSGKLGERVNVIASYAYIDAKTTEDPLYAGNQLWNVARHTASLAAVYDFGTVAGGDDLRIGADVRYVGARPGDSANSFTLPSYVLADAFATYDTRIGKQKLSFQLNVKNLFNRTYYPSSANRYFVAVGDARQVSLLTTLQF

SEQ ID NO: 149 - protein, 215 aa, Burkholderia cenocepacia
MNMKIATRLSVFALAGALLAGCATQQGNNTAVGTGTGAALGAGIGALAGGGKGAAIGAGVGALVGGVTGYNWQAIKNKLAPSAAQTGTQVTEQPDGSLKLNVPSSVTFATNQYAITPAFTPLLNDLATTLNQNPQVTASIVGYTDSTGSQQLNQTLSQNRAQSVVNALVQRGVNGGRLSAQGMGPSNPIADNATEAGRAQNRRVEIYLRAPQQHQ

SEQ ID NO: 150 - protein, 170 aa, Burkholderia cenocepacia
MMSNKARLALAVMMISALAACKSGVKLDDKANNAGAVSTQPSADNVAQVNVDPLNDPNSPLAKRSIYFDFDSYSVKDEYQPLMQQHAQYLKSHPQRHVLIQGNTDERGTSEYNLALGQKRAEAVRRAMALLGVNDSQMEAVSLGKEKPQATGHDEASWAQNRRADLVYQQ

SEQ ID NO: 151 - protein, 222 aa, Burkholderia cenocepacia
MNKLSKLAFIAATAVMAASASAQSVPASRQAVNDNWVNGTGEWVWMNGTNELCWRDAFWTPATANAKCDGALVAQAPQPPVAPVAPAITSQKITYQADALFDFDKATLKPLGKQKLDELASKIEGMNTEVVVATGYTDRIGSDKYNDRLSLRRAQAVKSYLVSKGVPANKIYTEGKGKRNPVTTGCNQKNRKQLIACLAPDRRVEVEVVGTQQVQKTTVPAN

SEQ ID NO: 152 - protein, 374 aa, Burkholderia cenocepacia
MSGVFVTAAHAQSSVTLYGLIDAGITYTNNQGGHSSWSERSGQINGSRWGLRGTEDLGGGLKAIFVLENGFNIANGTLGQNGREFGRQAFVGLSQDQFGSLTLGRQYDSVVDYIGPLSLTGTQFGGTQFAHPFDNDNLNNSFRINNSVKYTSVNFGGLKFGALYGFSNSNQFSNNRAYSAGVSYTYAGFNIGAGYLQLNNDTSGLTAAAVTNSAGAVAGDNTFVGKRQRVFGGGLNYTFGPATAGFVFTQTRVNRALGISAGASGVSSGLGLDGTFARFNNYEVNARYALTPALSLAGSYTYTAGFLDGRHPGWNQFNLQTDYALSKRTDVYVQGVYQRVSTDGLGIGAYVNGLGGASSTNKQIAVTAGLRHRF

SEQ ID NO: 153 - protein, 384 aa, Burkholderia cenocepacia
MKHPVIFAAALAAFAAPAFAETSVTLYGVIDEGFNYTNNVNVNGVGKTNYQLASGYAQGSRWGLKGTEDLGGGLKAVFTLENGFDVNNGRLGQGGRMFGRQAFVGLSESRFGTLTFGRQYDAVVDYLAPLTANGNWGGTLFSHPFDNDNTDNSFRVNNTVKYASADWNGLTFGGTYSFSNSTGFSNNRQYSIGAQYSLAGLQVAAAYLQANNPGIGSAGAIAADDANFVADRLRIFGGGVNYTFGPATVGVVYTKTDVKNPVSTVYLPASTFAGLGLTATKFQNFEINGKYQLTPDFYLGAQYVYTDGKYDAAAGSFKPKYHTVGLMADYSLSKRTDVYLQGAWQKVGGDKTGTAADGGYVVGTDGPSASSNQFSVRAAIRHKF

SEQ ID NO: 154 - protein, 362 aa, Burkholderia cenocepacia
MNKTLIVAAAAASFATVAHAQSSVTLYGVLDAGITYQSNVGGKSLWSMGSGIDQSRFGLRGSEDLGGGLKAIFTLESGFNIGNGRFANGNGGMFNRQAFVGLSSQYGTVTLGKQYDATQDYLAPLTATGSWGGTYFAHPLNNDRLSTNGDVALNNSIKYTSANYAGLQFGGTYSFSNNTNFGNNRAYSGGLSYQFQGLKLGAAYSQANLGDGTNTNGASTLGGQGRVRTYGAAAGYAFGPAQVGAAWTQSRIDNQAAGVPTLRADNYEVNAKYNLTPALGLGAAYTYTNAKVNNGSSHWNQFGVQADYALSKRTDVYAQAVYQRGAKGNNIVGTGIYNGDNTTASSSSVNQTAATVGLRHRF

SEQ ID NO: 155 - protein, 385 aa, Burkholderia cenocepacia
MKKLALSTLSLALLGAAGAAQAQSSVTLYGVIDTSITYVHGNDGQGNNSWSMGSGNLQGSRFGLKGSEDLGGGLKAIFQLENGFNSASGALGQGGRMFGRQAFVGLQSDQYGTLTLGRQYDPLVDLVQAVTADNYFGSVFATPGDVDNNDNSLRVSNAIKYTSPVWAGLQVEALYALGGVAGSTGKGQTWAAAAAYNNGPLGLAAGYFHANNSAPLSAVGQRTGWAGTSDAIFDGSGNFINNAYTSASSIGIAQVAGQYAFGPVTFGLGYSNAQYKADANSGFGTNQKYNTGRAFVTYQASAPLLLGVGHIYTKGSGQTDAKYHQVSLGADYSLSKRTDIYLVGAYQHASGKNADGTDAQASVGSYGIAGKSSQEIVALGLRHKF

SEQ ID NO: 156 - protein, 486 aa, Burkholderia cenocepacia
MFALNARGALRAPLALAAALALAGCSLAPRYERPAAPVPATYTPVDGGTTPAAEPATAQDAALLDDWHAYFTDPALQAWIDAALANNRDLRIAAGRLEEARALYGVQRADRMPSVDANLGYERARQYDPVVRESAISGLYRAGVGVSAYELDLFGRVRSLSEAALADYFATADAQRTVRIGVIAEVAGAYVSERSLHEQLALAQRTLDARERMAALTQRRYAAGTSDAIELRSAEMLVASARASQAALQREHAQAVRALQLLAGDFARNVPDDATALDTLSIAPVAPGAPSQLLERRPDIRQAEGRLKAANANIGAARAAFFPRIALTTDYGSVSDAFSNLFAAGTSVWTFAPRITLPIFAGGRNRANLDVAHARKDIAVAEYEKAVQTAFREVADAFAARDWIDRQLTAQQDVYAADGARLKLAERRYAGGVATYLELLDAQRSTYESGQELIRLRQLRLANAIALYRALGGGWAPATAEAAASA

SEQ ID NO: 157 - protein, 507 aa, Burkholderia cenocepacia
MMQKHALTAIAVALFATGCTMAPHYKRPDAPVAQAYPAGGVYATQPGAAGARSANGQAATAIGWREFFVDPRLQRLIEIALKNNRDLRVSVLNIEAARAQYQITRAGLFPTLDGTGTGNIQRLPAGVSTTRAPLISRTYNVGLSASWELDLFGRVQSLKDQALAQYLSTAYARQASEISLVSQVADQYLTLLSTDDLLKVTEDTLKTAQASYDLTKLQFDNGTGSELELRQAQTVVETALANQQAQARARAQALNALVLLIGEPLPDDLPAGMPLDAQNLLTDVPAGLPSDLLTRRPDVMQAEQTLLAANANIGAARAAFFPKISLTGAFGTASPTLGGLFKAGTAAWSFAPSIALPIFEGGQNIANLDLAHVQKRIEIANYEKAIQSAFREVSDGLAARGTYDQQIAALERNEHAQQRRFDLSDLRYKNGVDSYLSVLTAQTDLYSAQQSLISARLARWTNLVDLYRALGGGWIQHAGEAPRAPDAPVDYDKAAAPAPASATATNG

SEQ ID NO: 158 - protein, 158 aa, Burkholderia cenocepacia
MQGDKKVIEYLNAQLKNELTAINQYFLHARMYKHWGLDKLGKHEYDESIGEMKHADWLIERVFMLDGLPNLQDLHKLLVGEETEEILKCDLKLEQISQSTCKEAIAYCESVRDYVSREIFEKILDDTEEHIDWLETQIDLIGKVGLQNYQQTMMGSAE

SEQ ID NO: 159 - protein, 78 aa, Burkholderia cenocepacia
MIVCVCKSVSDRKIRASLAEGVNSFDELQFELGVATCCGKCEESVRDLMAEQGVCASRCGVEHHAHPIPVTFYDRKAA

SEQ ID NO: 160 - protein, 310 aa, Burkholderia cenocepacia
MLNFLVKRLFGLLPTLAIVAVLVFLFVHLLPGDPARLAAGPEADDATVALVRADLGLDKPMPTQFANFFVKIAHGDFGISTRSKRPVSTEIGERFMPTLLLTLVSMVWATAIGMAIGIASAVWRNRWPDRLGMTIAVSGISFPAFALGMLLMEIFSVKLGWLPVVPDGTWKSYVLPSLTLGAAVAAVMARFTRASFVEVLNEDFVRTARAKGVHEPMVVLKHCLRNAMIPVVTMMGAAVRLPARRLDRRRGRVQLAGARPPAGRCGDDARLPGDPGDRAAVLAGIHPDQPDRRRAVRGHQPDHPVQVRPA

SEQ ID NO: 161 - protein, 406 aa, Burkholderia cenocepacia
MKKRVAFAMTAVGLAAATAAHAQSSVTLYGIVDNGIAWQNNSSAVGATSGGHSKVQMSTGVWAGSRFGLKGSEDLGGGTKAIFQLEAGVNTANGSSQWTNGIFTRQAWVGLTNATYGTLTAGRQYTAYYTLLSPYSPTTWLTGYYGAHPGDIDSLDTSYRANNSLVYMSPKFYGFTVGGSYSFGGVAGATNRGSTWSAAIQYLNGPAGIAVGYQKVNNSTLGGGVWGANSTVQNGLTAAGDGNQPAVSSINNGYATAQSQQRIAVTAGYQFTPAWDISASYSNVQYTPGTGSFFRNKAIFNTAGAVLHWKAAAQWDFAAGYSYTAATQSNGITSSAKYHQVTLSQYYSLSKRTGLYAVEAYQHASGNTLNGRGNAIISATTSIGDGVGAGSKQNQIGVGVGMIHRF

SEQ ID NO: 162 - protein, 790 aa, Burkholderia cenocepacia
MSFTFAARPSRGRLALACAAAFAWPAAYAAATDDVRAGTARGGGVDRPPTTATAAPAAAGVAAASAPAGDTLSAVSVTAQRQPVDPDTPAVVTSITREQIDAHTNVTTEDALKYAPNLMVRKRYIGDRNSIFAGRDFNELQSARGLVYADGVLLSNLLGSSYAYPPRWSLIPPDDIARVDVLYGPFSALYPGNAIGSTVLLTTRRPEQLEASLSTQFFTQRYHDGYGFADSFGGNHQTARIANRVGRFWFALSLDRLENNGQPMQYAGPNSTYNPKLGAAVPVTGAATDIGPNGKPRTIVGAQTIERTEQLNETVRMGYAFTDHVDATLTLGHWENHYRQHGETFLRDAAGNPVYGGNVSIGGQNMTVAPNAFAPQRGDQENWLYALGLNGRLDSGWRLSGVVSAYDVSRDVLRAASTVQGGAGTLFQGDGTGWRTLDLKAEAPVVKGHTFTFGYHYDNYFLRNVTYNTADWLAGPTTSLASVYRGDTRTQALFGQDAWRFAPRWLATLGLRYERWDAYGGALGNARGTLGYADRGANALSPKVALQWDATEVWRFRLSFATGTRFPTVGELFQGTISNNAIVNNNPNLRPEKAIDWDFTAERDVGVGVVRASVFQSDLRDSIYSQTTVSGATTVTNISNVDRVRVRGVELAFSGENVGVRGLDLDANVSASNAQILADAANPAYVGSRFPRIPRMRANLLASYRFDEHWLTSVGVRYSGRQFNTLDNSDVNPDVYGGTSSFTVVDLKARYRFDRHWTASAGIDNVTDRRYYTFHPYPGRTFYGELKWSL

SEQ ID NO: 163 - protein, 742 aa, Burkholderia cenocepacia
MPFQPGGRALPSHVPTGHCASVTQQYIVSNSDPHRSLSDHPIPTDSPTMRDLPHLPLRPLSSLSLMLCAAVAHAQTDAPAASGTPAAAPAPLAPIFVTANPLGDTELIAPTVQLSGDALTRRQADSLGETLNGLPGVSTTTYGPMVGRPIIRGMDGDRIRLLQNGVAAYDASSLSYDHAVPQDPLSIERVEIVRGPAALLYGGNAVGGVVNTIDNRIPREAIEGMTGALDARYGGANSVRAGAAQVEGGNGRFAFHVDAFDRETSKLRIPGYARSSQQRAIDGPDAPQPEGNVPNSDGRVHGGAVGASYTWADGFAGLSYSGYESNYGSVAESDVRLRMRQERLAFASEVRNLSGPFTKLKFDFAYTDYRHKEVDNGETATTFRNRGYEARIEARHRKIGPFEGAIGVQFGQNTFSALGDEMLVPSTRTNSVALFGLEEWQVVPALKLSLGGRFEHVKVDPDPAGVEKFAGAQPRDFNAGSLSAGALFSLTPVWSIAANVAYTERAPTFYELYSNGPHDATGQFLIGNPNASKEKAVSTDLSLRYASGPNRGSVGVFYNRFSNYLTEYNTGRVVDDDGEPVAPGTDGSLNEAIYRGVRAEFYGVELDGKWRAFSRRGHTVDLELTADYTHARNVDTGQPLPRIAPLRATLAADYGYGPFGARAQVTHAWSQHRVPDDDFSTDGYTSLGVMLTYKFRVGPTHWLAHLRGDNLTNQEIRYSTSVVRGFAPQGGRSLMAGLRTTF

SEQ ID NO: 164 - protein, 424 aa, Burkholderia cenocepacia
MRVERVPYRLITVATAAVFLAACGKKESAPPPQTPEVGVVTVQPQAVPVFTDLPGRTSAFLVAQVRARVDGIVLRREFTEGTDVKAGQRLYKIDPAPYIAALNSAKATLAKAQANLVTQNALVARYKVLVAANAVSKQDYDNAVATQGQAAADVAAGKAAVDTAQINLGYTDVVSPISGRVGISQVTPGAYVQASQATLMSTVQQLDPVYVDLTQSSLEGLKLRQDVQSGRLKTSGPGAAKVSLILEDGKTYSEPGKLQFSDVTVDQTTGSVTIRAVFPNPGRVLLPGMFVRARIEEGVNENAFLVPQIGVTHDQKGQAIAMVVNASNKVEPRPLKTTGMQGQNWIVEGGLQAGDHVIVQGVDKVRPGATVKTVAAQLAPAADAASGAAAPAAPAAAGSGAAAASGAAASGAAPASAAAASSAQ

SEQ ID NO: 165 - DNA, 2265 bp, Burkholderia cenocepacia
atgaaaaaagtggagcagaagaagatggagtgggcaacaggcacgcgtttgcgtgcgatcgcagccgcggcaagcgtggcgttcggtacggcggcggcagggcacgcatacgcccagacggcgccggccgtgaacgcgggcgccacggcgtcggccagcagtgcgcaaaccggcgcgacggcgacgacgtcgaccagcgcgcaaaacggcacgctgccggcgatcaccgtcaacgcggcctcggcaggtgacggcacggtcgggctcgtcgcgaagcgcagcacgaccggcaccaagaccgacacgccgctcaacgagatcccgcagacgatcaacgtcgtcaccgcgcagcagatcgagatgaccggcgccaccgacgtgaacgcggcgctgcgctacgtgccgggcttctcgtcgtacgggtcggacaaccgctccgactggtacgcggcgctgcgcggcttcacgccgaccgcctacgtgaacgggctgcaggtgccgaacacgatcaacctcgcgagctggcgcgtcgatccgtacatgatcgacagcatcagcgtgctgcgcgggccgacctcggtgctgtacggcgcgggcgatccgggcgcgatcatcgacgtgcacaccaagctcgccgacggcgagcgcgtgcgcgaagcaggcgtgcagatcggcaactacgcgcgcaagcagttcatgatcgacgtcggcgacaagctcgacccggacggcaagtatgcgtaccggttcgtcggcgtcgcgcgcgacggcaacgcgctgacgggcccgaacaacgaccagcgcgtcgcgctcgcgccgtcgttccgctggcgcccggacgcggatacgtcgctgacgctgtccgcgacctacctgcaggactggggcgacatctcgtcgaacttcctgcccgcgcaaggcacggtgctgccgaacccgaacggccagatcaacaaggacatctacgaaggcgacggcaacttcaactactaccgcaagaagcagtggtcggtcggttaccagttcgagcgcaacctgacgccggcctggacgttccgccagaacacgcggctgatgcacctgtcgctcgacaacggctcggtgttcggcaacggcttcgtcgaaggcagcacgaccgacgtgtcgcgctgggccggcgtgttccagatgaactacagccgcttcgacatcgacaacaacctggagggccgcttcgcgacgggcccgttgcagcacacgctgctgctcggcttccagtacaaccgccagaccgcgaccgacagcgaatggctcgccgccgcgccgccgctgaacatctacaacccggtgtaccagcccgtcacgacggcggtgttcacgcccgacgcgacgatccgcaccaacacgtacacgacgatcaacacgttcggcctgtacgcgcaggaccagatcaagtggaaccgctggacgctgacgctcggcggccgcgaggactgggtcaacatgcggatggacgaccgcgcggccggcacgtcgacgaaggcggacgtcacggcgttcaccggccgcgtcggcctcacgtaccagggcgactacgggctgtcgccgtacgtcagctacgcgacgtcgttcaatccgctgatcggcgtgaacctggtcggcggcgggctgccgcagccgacgcgcggcaagcagatcgaagccggcctgcgctggcagccgcccggcaagaacctgatgctgaacgcggcgatctaccagatcaaccagaccaacgtgctcacgtcggcgctgccgagccaggacccgaccggcacgaagtcggtgcagacgggcgaagtgcgctcgcgcgggatcgagctgagcgcgaccggcaaggtcacgcgaaacctgtcggtgatcgcgtcgtacgtctatcaggacgtgaagaacgtgcaggccaacgacgtctcgctgaacaactggccggtcgacattccgcgtccgcgccagatggcgtcgctgtggaccgactggacctggtacacggggccgctcgccggcttcggcctcggcggcggcattcgctaccagagcgcgtcggccggtgcggccgacaactcgctgacggtatcgagcgtcacgctgttcgacgcgggcctgcattacgacgtgcgtaactggcgcttcgccgtgaacgggacgaacctgttcaaccgccattacatcagcggttgccagtcgaacaacgtgtgcattttcgggaccgaccgcaccgtgatcgcgaccgcgaaatacaactggtga

SEQ ID NO: 166 - DNA, 1542 bp, Burkholderia cenocepacia
atgaataacttgcacaacacgaacggcctgatgcgcttcgcgaaggtggcggccgcgagcaccctgctcgcgacgctgctcgccgcgtgcgcggtcggccccgattacaagcgtccggacgcggcggcgcccgccgcgttcaaggaagcgccgaccctcgccgccggcgagcaggccggcacgtggaagacggccgagccggcggacggcgaacatcgcggcgaatggtggaaggtgttcggcgacccggtgctcgattcgctcgagacgcaggcgctcgccgcgaaccagaacctgaaggccgcggccgcgcgggtcgaggaagcgcgtgcggcgacccggtcggcacgctcgcaatggttcccgcaggtcggcgctggtttcgggccgacgcgcgaggggctgtcgtcggcgtcgcagttccagccgcagggcaccggcccgaccaacgcgacgctgtggcgcgcgcagggcacggtgtcgtacgaagccgacctgttcggccgcgtcggccgcaacgtcgaggcgtcgcgcgccgaccaggcgcagagcgaagcgctgttccgctcggtgcagctcgcgttgcaggccgacgtcgcgcagaactacttcgaattgcgtcagctcgattcggatcaggacctgtaccgccgcacggtggagttgcgcgagcaggcgctgaagctcgtgcagcgccgcttcaacgaaggcgacatcagcgagctcgacgtgtcgcgcgcgaagaacgaactggcgagcgcgcaggccgatgcggtcggcgtcgcgcgccggcgcgcggcgtccgagcatgcgctggccattctgctcggcaaggcgcctgcggatttcgcgttcaaggaaacgccgatcgtgccggtcgcggtgaagattccgccgggcctgccgtccgcgctgctcgaacgccgcccggacgtgtcggcggccgagcgcgcgatggcggccgcgaacgcgcggatcgggctcgcgaagtcggcgtacttcccgaagctcgatatcaccgggtcgttcgggtatgaagcgtcgacgctcggcaacctgttcctgtggtcgagccgcacgttcctgctcgggccgttcgccggcaccgcgctgacgctgccgctgttcgacggcgggcggcgggctgctggtgtgcagcaggcgcgcgcgcagtacgacgagcaggtcgcgaactaccggcagcaggtgctcgtcgcgttccgcgaggtcgaggacaatcttgctgatctgcgtttgctcgatgatcagatccgcgcgcaggatgcggccgtcaacgcgtcgcgtcgggcggcgacgttgtcgcgcacgcaatatcaggaaggtgaggtcgcgtatctcgacgtgatcgacagtgagcggtcggtgttgcagtcgcagttgcaggcgaaccagttgacgggggcgcaggcggtgtcgaccgtcaacctgatccgcgcgctgggcggcgggtgggggaatgcgccggcgccgacggcggtgggtgatgcggcgtctggcaaggctgacgtagctgcgcggtaa

SEQ ID NO: 167 - DNA, 2244 bp, Burkholderia cenocepacia
tcagtagcgcgcgttcagcgtgacgaacgccgaacggccgggcgcgatcgacgcatagtgcgccggatacgcctgatcgaagtaggtgcggttgaacaggttgttgacgttcagttgcaggtcgagcttcttgttgatccggtactgcgccatcgcgtcgaagcgccagtacgacggcacggcgcgcaggttcgcgggatcgccgaatacttccgacatatagaacgcgccgccgccgaccgtgaacttcggcgtgacgtcgtagttcgaccacatcgtcaggctgtgcttcggcgtgttcgggaagcggttgccgttgttcgcggcgtccttgccgttgtcgcgcagttggctcttcatgtacgtgtagccgccgaacacctgccattgcttcgtgatctggccggcgaggccgagctcgagaccctgcacgcgcttgttgctgaccatcgcgtactggttgttcggcagcgtcacgcgtgcgttggtcgtgtcgatctggaacagcgcggccgtcagcgacagcttgtcgttcagcacgttccacttcgtgccgagctcgatgctgcggtttttttccggcgaaagctgatcggcgttcgggccgacgccgccgcggcccggcgtgagcgactgcgtttcgctgccttcgccgagcatcatgccggcgggcgtcgacgaggtcgcatacgacgcgtagatgctgccgttctgcgcgggcttgaacacgaggccggcctgccagttgaagagcgtgtcgtcgcgcgtataggtcttgccgccattcgccttggtatcggtgaagcgggtcgagtagtcgtcgacgcgcacgccggcgttgacttgccagcgcggcgtgatctcgatcgtgtcgaagccgtagatcgacttcgtcgtggtgcgcgcatgcgcgtagtcgttgttgcgcgtgatcgaaccggcccacggatcgttcgggttcggcgaccacaggctcgtgcagttgtagcccgacgcggcgccgatgcctttctggcagatcgtgcccttgtcggtcgcgaccgtgtacgaatcgcgcttgccccattcgcgcgacagctcgataccggtcgtgaagctgtgcttgaacgggcccgtgcggaattcgccgaacagctcggtcaggttcgcgaggctgttgatcgagctgttgcggttgttgttgcggcgccagaccttgccgttcaccacgttgccctggctgtcgtccggctgcgtccagatgtagtcctgtgtcgattccgtgtagcgcgtggtgttgcgcaccgtgaggttcggcgtgatgtcgtgctcgatcttgatcgtgctgatgtccgacgtggtcttgcggaagtcgcggtcgatcaggccgtagaagttgtggcgatcgacgggcgccggatagatcgtgccgacgttcgcgggcttgttcgacgtcgtgtagaagtacgggatgccgccgtcgggcatgtcgtccgtctgcaggtggtagtagctcgcggtcacgcgcgtcggcgtgccgaggccgaacgcgatcgacggcgcgacgccccagcgctcgttgttgacggcatcgcgaccggcgacgtcgttgttgtggctcatcaggttcaggcggaacgcggcgtgctcggcgaactgccagttgccgtcggcggtgaagcggcgatagcggtcggtgccgaggcccgcgctcgcggcggccgtcgtgccgaggtgcggggccttcgtgatcaggttgatgctgccgccggcgccgccgcggccgccgtacgcgccgtcggaacccttcgtgatctcgacgcgttcggtattgaagatctcgcgcgtggtggcgcccgtgtcgcgcatgccgtcgacgaacatgctgccctgcgtgtcgtagccgcgaatgaacggacggtcgccgagcgggttgccgccttcgccggcgccgaacgtgatgccgggcacggtgcgcagcgcttcggtcagcgtcgccgcgccgctgctctggatcagttcctgcggaatcacggtgacggatttcggcgtgtcgacgagcggcgcggtgaatttcgcggaagcggaaaagtcggccttgtagctgtgctcggtcttgccctggatctcgatcggcgcgaggtggccttcggtgctggcgggcgccgcgggcggcgtaccgtcggcgaacgcggggctcgcggcgagcacgctgcacaaggtggtgaacttaccgagcttcagctcgtccggacgggatttcat

SEQ ID NO: 168 - DNA, 2268 bp, Burkholderia cenocepacia
tcagaaatccactttcatgctgacggcgaccgtgcggccgggcgacgaatatgcgtcgagcacctgcgaatcggccgcgatgccgcgcacgtccgaccagttccagtacttgcggtcgaacaggttgcgaatgccgatcgtcgcgctcacgtgcttgttgaagcgatagccgccgcgcaggtcgacgacgaacgacgacggcggcgtgaagcacgccttgttcgaacagtcggacttgtcgacgtccttgtcgcgtttggcggcctggaacagcaggtcggtctgcacgaaccagcgttcggtcggctcgtaccgcacgccgaacacggccgagaacgggttcacggtattgagcggctggctcgccgcgccgtcgttctgcgtcgagcccttcgtgaacgccatcgccgtcttcagcgtgatgccgttcggcatcacccattcggcgcggccttcgaggccgtggatgcgcgcgtcggcgaagttcacgtactggaacacgaacgggtcgaccggccggccgctgccggcgagcgtcgtacgcgagatgaagttgcggtagcggccggtgaaggcggccgcgctgtagcgcacgacgccgtagccggtgccggccttgccgcgcaggccggcttcgaacgtgtcgctggtttcgggcttcaggttcggattgccgatcgacgtgtagccgtacaccgggttcgagaagctgctgttcacctggtcgggcgtcggcgcgcggaagccgtgcgcgtactgcacgtacggaatgaccgctggagtgatttcgtagagcacggcgacgcgcggcgacagctcgttggcgctcgtcgacacggccttgccggtgaacagcggatcgttttcggtcgggctcagccggtacgtgtcgaagcgcaggcccggcgtgacgagcaggcggccgtagccgatctggtcctgcacgaacgcgccgaacagcgtgtagtcggtgtcgggaaacgccttgttcgggaacgcttcgccgacgcccggcaccgtgccgtcgcgcaggttcgtcacgcgcgacaggctgccgtcgacgccgtacaacagcttgtgcgcgagcgggccggtcgaaaagccgctttcggcgaacgcggcgccgccgaacgtgcgttccttgtactggttgtcgcgcgaacgcgagggtagcctgccgcgcgtctcgaacgcgtactggtcctgcttcgcgtcctggtagtagaactgcacgtgcgcggtctggaaccagcggaacgcgtcgtcgcgaaagtcgtagtcgacgctgaagcggttgcgctcgagccggtcgtgggtcgtgaggccgagcgtggccggcgcattgatcgccgacagcacgtcggtgctcacgcgccgctgcaccgtttcggcggtgaacttgatcgtgtcgcgtgtggtgggcgtcagcacgagcttgccgagcagcgattccgaatacacgtcctgcggattcgacgtcgtgcgcagcgtgctcgccgaattgttgtcgccgcgcgtgtcgacctcgtggccgcgccggccgtcggcgatgatcatcccctggatgcgatcgttgccgcccgcggccgatacggtcgcgccgatgctgcggtcggtcgagtcgtagctcggccggaacgagaagtagtaaggcttgtggtagatcgacagcaggtcgcgcgggtccttcgtgatgaagttcaccgcgccggtcaggccgtcgctgccgtacagcgccgacgccggcccgcgcaggatctcgatgcgcttgagcgtgtcgagatcggcgtagtcgccgcggcccgcttcgagcggaccgaacgagaacgcgttcggcaggcggatgccgtcttccatcagcagcacgcgattgccttcgaggccgcggatgttgatgctcgaatcgccgtcgcggccgccgccgagcgcggcgctgccgggccggtacgcggtgcggcgcaccgtgatgcccggctcgtagcgcagcgcgtccttgatattggtggcctgttgctcttcgagatcctcgtcggtgatcaccgacacggacgccgccgtgcggctcgccgcggtggcggtgcgggtggccgtgacggtgacgggatcgagcagcgccgcctcgccgcgcgcggatgcggcggtcaggacggcggaaggcgggggggcgccttgcggcgacgaatcggcgtgagccggggcggcggacaggccgaacgcgccgaacagcgcggcacagatcggccgccgcgccagcgtatagcaatgcac

SEQ ID NO: 169 - DNA, 2217 bp, Burkholderia cenocepacia
atgcggtacgaggtacgggaacctgagagatcgatgatgcagggcgcacgcgtcgcccgtttcgggcgctggcgtccgtcgctgtacctcggcctgctgatcgccgcgcatccggcggcggcgttcgccgatgcggcgccggcggccggcgcggaagtccgccgggacaaagcggccgccgcgcagcctgccgggagcgagttgaaggcgattgcggtgaatgcgtcgcgcggcgtcgccgacgatccgtccgtggcgacggtcggcaagatgccgctcgcgttgcgcgagattccgcagtcggtcagcgtgacgacgcgcgagcggatcgaccagcagaacctgttctcgctcgacgaggtgatgcagcagtcggccggcgtgaccgtccagccgtacgtgctgctcaccactgcgtacttcgtgcgcggcttcaaggtcgattcgttcgaattcgacggcgtgccggtcgtgatcggcgacatggcgagcgcgccgcaggacatctcggtgtacgaacgcgtcgaaatcctgcgcggcgcgaacgggctgctgcacggctcgggcaatccggccgcgaccgtcaacctcgtgcgcaagcgcccgcaataccagttctccgcgcatgcgaccgccagcgtcggcagctgggaccgctatcgcgcggaagccgacatcggcggcccgctcaatgcggccggcaccgtgcgcagccggctcgtcgccgcgtacgaggatcgccacttcttctacgaccacgcgaagcaggacacgcgttcgatctacagcgtcacggaagtcgacgtgacgcgcgacacgctgctcacgttcggcgcgcagtaccagaccacgacatcggtgcccgacatgtccggcgtgccgatggcgcgcgacgggtccagcctcggcctgtcgcgctcgacgttcctcgacaccgcgtggggccgtttcaactgggacacgacgcgcgcgttcgcgtcgatcgagcagaagctcggcgccggctggaaggcgaaggtcagcggcgaataccagagcgtgcgctcggacctgaagtacgcgggttcgtttggcgcgatcgatccggcgacgggcgccggcggccggctgaccggcgccgcgtaccagttcagcagctacagccgcagcatcgatgcgaacgtgcagggccccgtgcatgcgttcgggctcacgcacgacctgctgttcggcgtcacctacgcgaacagcagcagcgggcagatgaccgcgccgctgctcggcgacgtggccggcacgccggtgaacgtgtaccgctggaacccgagcagcgtgcccgagcccggcatcgggccgtaccagcagtcgcagcagaacgacgtttcgcagaagggcgtctacgggctgggccgcatcaagctcgcggagccgctgacgctcgtgctcggcggccggatgagctggtggaaccaggacagcctcggcgcgcactacaacaccggccaccagttcacgccgtacggcgggctgatctgggatttcgcgcgcgactggtcgtggtacgcgagctatgcggaggtgttccagccgcagaccaagtcgatgtggggcggcggcatcctgacgccggtgaaggggcgcacctacgaaacgggcgtgaagggcgaactggcgggcggcaagctcgacgtgtcgctcgcggcgttccgcatcgatctcgacaacaacccgcaggtcgacctcgcgcatccgtgcgcggggccgagctgctactacgtgaacggcggcagcgtgcgcagccagggcttcgagttcgaggcgaacgggcgcatcacgccgtggtggagcgtgtgggcgagctacacgtacgacacgatgcgttatgcggacaacctcgcgaacgcgggttcgttcgcgccgctgctgaatccgcgccacctgttccggctgtggaccaactacgacctgccgtggcaggagcggcgctggagcatcggcggcggcgtgcaggtgcagagcagctactcggcgcaggcgaacggcgtcacgatgagccagggcggctacgcgctcgcgagcgtgcggctcggctaccgctacgacaagcactggagcgccgcgctcaacgtcaacaacctgttcgaccgcacctactacctgagcctgagccagccgggctggaacaaccgttacggagaaccgcgcaacgtgatgctgaccgtgcgcgggcaattctga

SEQ ID NO: 170 - DNA, 2091 bp, Burkholderia cenocepacia
atggccaccaccggcgcgctggccgccgaagctgcggcgtcggcgccggatgaccggcacgcgctgccggcgatcaacgtcaccgcgtcgtccgcgccggccgatccgctgacgcaaccgctcgaaacgggctcgcggctcgggcttgccagtctcgacacgcccgcgagcgtcgaaaccgtcacggccgacacgatcgacgcacgcggcgatcgcacggtgctcgacgcggtcacgcgcacggccggctttgcgagcgcgatcgcaccgggcaccggcggcaccgcactgagcgtgcgcggcttcagcgggcaggaatcggtgatgacgctgcttgacggcgtgcggctgatgccggcggccggcacgatcacgtttccgttcgacacgtggtcggtcgcgcgcatcgaggtgctgcgcggcccggcatcggtgctgtacggcgaaggggcgatcggcggagtcgtgaacgtggtgccgaagcggccgcagcgcacgcgcgagacgacgctgcaggcgggcgtcggccccgacggcgcgaagcgcttcgcgttcgatacgacgggcgcgctcggcccgcggctgtcgtaccgcttctacgcaagcgatgcgcgtgcgaacggtctcgccgagcgggccgacacccatacgacggccatcggcggcgcgctgacattcgacgtgagcccgcagctcacgctgacgctcgactacgactacgggcgccagatgccggcgacctactatggcgtgccggcgccgcacggcgtgctcgatccgtcgctgcgcaagctgaactacacggtcggcgacgcgacgatttcgtactacgaccagtggacgcgcctgtcggccagctaccggcccgcgcccggcgtgacgatcagcaaccagctctactacctgacatcgaaccgtcactggcgtaacgccgagtcatatgtgctcgacctcgcgacgggacgcgtcacgcgcggcgactatctcgacatcggccatcatcagcggcagatcggcgatcggctgagcgcgcgtttcgacgggatgctgttcggtcgcgcgaaccgtttcgtcgtcggcacggaattcagccagatcacgttcagcggtaccaacaattcgccgtatggtggcgaaacgacggtgcccgcgcacggcttcgatcctggtgtgttcacgagcccggacccgaccgtgccgcaattcagcacgcgcgcacggcaggcggcggtattcgcggagaaccggctcgaggtgctgccgcggctcgcgtgggtgagcgggctgcgctacgaccacatcgcgttcagtcgcgagcaggcggcgaccggcgcgggcttcgacaagcggttcgcgaacgtcggctggcgcaccggtgtcgtgttcgatatcgcgccggcgttcaccgcctatgcgcagtacacgacgggcgcggagggcgtcggctcgctcgtgacgctgtccgcgtcgcagatgaacgtccggctcgcgaccggcgaacagtgggaagccgggctcaagcagacgctgctcgacgggcgcgcgtactggacggtcgcggtgtacgacatcacgaagcgcaacctgctcagcaccgatccgttcaatccggcgctgcgccagcaggtcggccggcagtcgtcgcgcggcgtcgatctgaccggcggcgcgcggctgtcgcacggctggacgatcgatgcgaacgtcgcgttgctgcgtgcgcgctacgacgcattcaaccagacggtcggcggcgcgacggtgtcgcgggccggcaacgtgccgtcgggcgtgccgcagcagaccgcgaacctgtggctcggctgggcattcgccgagcgctggcacgtgaatgcgggcgtgcgttacgtcggcgcgacctacggcgacgatgcgaatcgcgtgcgggtgccgtcgtatacggtgttcgatgcgtcgctgcgctggcagccgacgtcgcgcaccgagctcgcgctgtatctgcgcaatctcgcgaaccgcacgtatgcggtaacgacgtcgaacggcggcgagcaatggctgctcggcccgtcgcgctcggcggagctcgtcgcgacgatgcgcttctag

SEQ ID NO: 171 - DNA, 2133 bp, Burkholderia cenocepacia
ctacagcttcgcgctcacgcgcacccacgcggtacgccccggctccatcaccggcgcgttcgccggatagccgaaacccgcgttgccggcgaggttcagatgctcggtgtaggccttgttcagtacgttgtcgacgccgaccgagatttgcacggtcttgctgacgttgtattgcgtatgcagcgacagcacgccgaatccggcgctcgggccgaagtccttgccgaccacgttgccctcgttcagcgcgtagcgatgctgcggcgcaacgatgcgccacaggccgcccgccgaccacgcgccgcgcgtgtattcgaggccgatgcgcgcctcgagcggcggcatctgcggcagcggatcgccgctcgccacgttgcgcccccacgcatacgcgagcgacgtctcgacgcgcagcggcgcgaccggccgccacgacacgccggcttcgccgcccatgatctgcgcgttgacgttggttgcctgcgtgatcgggcccatcatgccggccgcatagttgaacaggatgaagtcctggacgtagcccgcgtacgccgacacccatgcatcgaaccggtcgctcttgtattgcgcgccgatatcgagctgcgtggtcttctccggctgcaccgccgagaacgcgttgatcgaaccggccggcccgcgcgtcgcggagaacagttcccagtagtccggataacgctccgcgtggccgatccccgcgtaccacgtgacgggtagcgacgcgagatcgcgctcgtagcgcacgaagccgctcggcagcaccttcgtccgatcgtcgtcgaaagtcgggttcggcttgctcatcatcatgccgctcttcatcgcgcgcttgtcgcgtgcgctcgcatagtcgacgcgcgcgccgccgatcacacgcgagacgtcgctcgcataccacgtcagctcgctgaacacgcccgcgctccacatggtcgcctgggcatcccacggctggtcgcggtagttctgctgccccatcgacgcacgcgaatcgagccggttcgattgcgcatcgacgcccgtgacgagcttgaaatcgtcgccgaagcggaacgtcgcggcggcacgcgcgccgaccgtgcggcgccgcacgtccgcggccatgcgcatcggcatgctgctcgtcgggtcgggctgccgcaacgtgtagttgtccatcacgtgatcggcttcgttgtagtacacgcgcgcctcgatccggtcgagcacgtcgccgagatgccgcttgtcgaacgacaggccgaacgtctcgcggcggaaatgcgcgccatccatcccgcggcccgcgtagcgcgcatagccgtcgccggtgccggcggtcagctcgagtcgcgtatggtcgtcgggcgtccagccgagcgctgcatcggcgttccatttgtcccactgcgacggcacggtgttgccgttgccgtccttgtagtcctgcgaatgcgcgtggttcgcggtcacgcggccatagatgtccggcgtgcctgcggtcaggtcgatgttctggtcgttgcggccgaacgacccgccgacgagactgccgtcgaagcgcatgccggggcgctcgaaacgcggcgtcacgcgctcgaacagcacggtgccggccgacgcacccggaccgtacagcacggtctgcggccccttcacgacggtgaccttgtcatagctttccggcgcgatgtacgaggtcggcgcatccatccggttcgggcacgcgccgagcgtcggcattccgttcgccaggatgttcagccgcgaaccgaacatcccgcgcagcacggggtcgccgttcgtaccgccgctacggatcgacgtgaagccgggaatcgtcttcaggtaatcggcgccgtcgctggcgggcagcggctggcgcggcgccttcggatcggtgacgacgacgagcggcgtcgacagcggcgacgcgacgacttcgacgggcggcaacagcatcgccgcatcgcccgacggcgcaccggccgccggcgtggtttcggctgcggcagcgctcgcggccagcgcgccgacagccagcgcaggaacggtgagtttcagtacgcgcggcagaggccgcgcaccggcattgcgtggcgcccgcggcgcacgcaacaggaaattggtcat

SEQ ID NO: 172 - DNA, 2568 bp, Burkholderia cenocepacia
atgggtaatgaaagcagccctagcccatcgtccaccgactctccgatcatggcttccatccgtctcacgtatcagcgccgtccggcgcccgcccgtcatctgccgcgcgcgtcgcgcccggccgcgtcgggccgtcttgcccgccggctggcgggtgccgtcctgctgtcggcactgctgccgctgcccgcgctggccgacaccgacgccgatgcggcgcccgccacgcagcgcgcgtcgcgtcgggcgttcgacattccggccggcccgctcgaagcggcgctgaaccggttcggccgcgacgcgggcatcctgctcgcatttccgcccgagttgacggccggtctcgcgagcggcggcgtgcacggccggttcgacgtcgacggcgcgttcgaccgcctgctggccggcacggggctcgtcgcgctgcgccagccgggcggtggctacacgctgatgcgcgccgatggctcggcggccggccctgtggcggccggcgtcgcgccagccgccgagttgccgacgatcgacgtgcgctccagcgccttgcgcgccgaaagctatcgcgcgccgaaggaagcgggcgtgctgcgctccgacattccgctgctcgacaccgcgcaggccgtcaacatcgtgcccgcgcaggtgctgcgcgaccagcggccgcgcaatctcgacgatgcgctcggcaacgtgagcggcatcacgcagggcaacacgctcgcgggcacgcaggacacgatcatgaagcgcggcttcggcggcaaccgcgacggctcgatcatgcagaacggcatgccgctcgtgcagggccgcgcgttcaacgcggcgaccgacagcgtcgaggtgctgaaggggccgacgtcgttgctgtacgggctgatggacccgggcggcgtcgtcaacgtcgtcaccaagcagccgcagctcgtgcgctacaacgtgatctcgctcggcgcgtcgacgttcgggcacggcaagaacggcggcagcgcgacgttcgactcgaccgggccggtcggcgattcgcggctcgcgtaccggctgatcgtcgaccagtcgaacgaacagtactggcgcaacttcggcgagtaccggcagaccttcgtcgcgccgtcgctcgcgtggtacggccgcgatacgcaggtcgcggtgtcgtaccagtaccgcaagttccattcgccgttcgatcgcggcaccgcgctcgacccgcgcaccaatgcgccgctcgacatccccgcacggcggcgcatcgacgagccgttcaacaacatggacggcgaatcgcagctcgcgcaactgagcgtcgatcaccagttcaacgcggactggagcgcgcatttcggctacagctacaaccgcgagacctacgacgcgaaccagttgcgcacgaccggcgtcgaccctgtgaagggcacgatgacgcgcagcaacgatgcgacgcacggctcgctcagcaccgacagctacgggatcggctacgtgaccggcaagctgacgctcgcggggatgcggcacgacgtgcaggtcggcttcgataccgaataccgccgcatctatcgcaaggacctgctgcgtcaggcggtgaagacgccgttcagttatatcgatccggtgtacgggctgctgccgccgtcgagcacggtgtccgcgagcgacagcgaccagaccgacacgctgcacgatgcatccgcgttcttccaggatacggtccacctgaccgacaagtggatcgtgtcgggcggcctccgctacatcacgtacaaccaggtggcggggcgcggccggccgttcgtcgcgaacaccgatctcagcggctcgaagtggctgccgcgcgcgggcgtcgtctacaagtggaccgatgcgttctcgctgtacggcagctattcgcagtcgctgaagccgtcgtcgtcgatcgcgccgatgacgggctacatcatcgacggcgcgacgccgcccgaggaagcgaccgcatgggaagtgggcggcaagctcggcttggccggcgggatgaccggcacgctcgcgctgttcaacatcgacaagaagaacgtgctcgtgtcgcagtacaacgacgcgacgaagctgaccgactggcgcacgtcgggcaaggcgcgctcgcgcggcgtcgagctcgacgtctccggcaagctcggcgagcgcgtgaacgtgatcgcgagctacgcgtacatcgacgcgaagacgaccgaggacccgctgtacgcgggcaaccagctgtggaacgtcgcgcgtcacaccgcgtcgctcgcggccgtctacgacttcggcacggtggcgggcggcgacgatctgcgtatcggcgcggacgtgcgttacgtcggcgcgcggcccggcgattcggcgaacagcttcacgctgccgtcgtacgtgctcgccgacgcgttcgcgacctacgacacgcggatcggcaagcagaagctgtcgttccagctcaacgtgaagaacctgttcaaccgcacgtactacccgtcgagcgcgaaccgctacttcgtcgcggtcggcgacgcgcgccaggtgtcgctgctgaccacgctgcagttctga

SEQ ID NO: 173 - DNA, 648 bp, Burkholderia cenocepacia
atgaacatgaaaatcgcgactcgcctgtccgtattcgcactcgccggcgcactgctggcaggctgcgccacgcagcaaggcaacaatacggccgtcggtaccggcacgggcgcggcgctgggcgcggggatcggggcactggccggtggcggcaagggcgcggcgatcggcgcgggcgtcggcgcactggtcggtggcgtgacgggttacaactggcaggcgatcaagaacaagctcgcgccgtcggcagcgcagacgggcacgcaggtcaccgagcagccggacggctcgctgaagctgaacgtgccgagctcggtcacgttcgcgacgaaccagtacgcgatcacgccggcgttcacgccgctgctgaacgacctcgcgacgacgctgaaccagaacccgcaagtcacggcgtcgatcgtcggctacacggacagcacgggctcgcagcagctgaaccagacgctgtcgcagaaccgcgcgcaaagcgtcgtgaacgcgctcgtgcagcgcggcgtgaatggcggccgtctgtcggcgcaaggcatgggcccgtcgaacccgatcgcggacaacgcgaccgaagccggccgcgcacagaaccgccgcgtcgagatctacctgcgcgcgccgcaacagcatcagtaa

SEQ ID NO: 174 - DNA, 513 bp, Burkholderia cenocepacia
ttactgttggtagacgaggtcggcgcgacggttctgcgcccacgatgcttcgtcgtgacccgttgcctgcggcttttccttgccgaggctcacggcttccatttgcgaatcgttcacgccgagcagtgccatcgcacggcggacggcttccgcacgcttctggcccagcgcgaggttgtactcgctcgtgccgcgttcgtcggtgttgccctggatcagcacgtggcgctgcgggtggctcttcaggtactgcgcgtgctgctgcatcagcggctggtactcgtccttcaccgaatagctgtcgaagtcgaagtagatgctgcgcttcgcgagcgggctgttcggatcgttcagcggatcgacgttcacttgcgcgacgttgtcggcgctcggctgcgtgctgactgcgcccgcgttgtttgccttgtcgtcgagcttcacgcccgacttgcacgctgcgagcgcgctgatcatcatcacggccagggccagacgagctttattcgacatcat

SEQ ID NO: 175 - DNA, 669 bp, Burkholderia cenocepacia
ttagtttgccggaacggtcgtcttctgcacttgctgcgtaccaaccacttcgacttccacgcggcggtccggtgcgaggcaggcgatgagttgcttgcggttcttctggttgcagccagtcgtaaccgggttgcgcttgcccttgccttccgtgtagatcttgttggccggcacacccttgctgaccaggtacgacttcacggcttgcgcacggcgcagcgacagacggtcgttgtacttgtccgaaccgatacggtccgtgtagcccgttgcgacgaccacttccgtgttcatgccttcgatcttcgaagccagttcgtccagcttttgcttgcccagcggcttgagcgttgccttgtcgaagtcgaacagtgcgtcagcttgatacgtgatcttctggctcgtgatggccggagcgaccggagcgaccggcggctgcggtgcctgggcgaccagtgcgccatcgcacttcgcgttggcggtggccggcgtccagaacgcatcgcgccagcagagctcgttcgtgccgttcatccacacccattcgcccgtgccgttcacccagttgtcattgacggcttgacgcgacgccggcaccgactgtgccgaagcggatgcagccataactgcggtagctgcaatgaacgcgagctttgaaagtttattcat

SEQ ID NO: 176 - DNA, 1125 bp, Burkholderia cenocepacia
tcagaagcgatggcgcaggccggcggtcaccgcgatctgcttgttggtcgacgaagcgccaccgaggccattgacataggcgccgatgcccaggccgtccgtgctgactcgctgatacacgccttgcacatacacgtcggtccgcttggacagcgcatagtcggtctgcaggttgaactgattccagcccggatgacggccgtccaggaagccggcggtgtacgtgtacgacccggccagcgacaaggccggcgtgagcgcgtagcgcgcgttcacttcgtagttgttgaagcgggcgaacgtgccgtcgagacccaggccgctcgacacgcccgaggcgcccgcggagatgccgagcgcccggttcacacgcgtttgcgtgaatacgaagccggccgtggcggggccgaacgtgtagttcaggccgccgccgaacacgcgctgacgcttgccgacgaacgtgttgtcgcctgccaccgcgccggcgctgttggtgaccgcagctgccgtgagccccgaggtgtcattgttcaactgcaggtagccggcgccgatgttgaagccggcgtaggtgtacgacacccccgcgctgtatgcacggttgttcgagaactggttgctgttcgagaagccgtacaacgcgccgaacttcaggccgccgaaattgacgctcgtatatttgaccgagttattgatccggaacgaattgttcaggttgtcgttgtcgaacgggtgggcaaattgagtgccgccgaattgcgtgccggtcagcgacagcggcccgatgtaatcgacgacgctatcgtattggcgaccgagggtgagggagccaaactggtcttgcgacaggccgacgaacgcctggcggccgaactcgcggccattttggcccagcgtgccgttggcgatgttgaagccgttctccaacacgaagatggctttcagtccgccgccgagatcttccgtgccgcgcaggccccagcggctgccgttgatctggccgctgcgctccgaccatgagctatgcccgccctgattgttcgtgtaggtgatgcctgcatcgatcaggccgtacagcgtaacgctgctttgagcatgggctgcggtaacgaatacacccgacaa

SEQ ID NO: 177 - DNA, 1155 bp, Burkholderia cenocepacia
atgaagcaccccgtcatttttgccgccgcgctcgctgccttcgccgcgccggcctttgccgagaccagcgtgacgctgtacggcgtgatcgacgaaggcttcaattacacgaacaacgtcaacgtcaatggggtcggaaagaccaattaccagctcgcgagcggctatgcgcagggcagccgctggggcctgaagggcaccgaggatctcggcggcgggctgaaggcggtcttcacgctggaaaacggtttcgacgtgaataacggccggctcggccagggcggccgcatgttcggccgtcaggcgttcgtcgggctgtccgagtcgcgcttcggcacgctgaccttcggccgccagtacgatgcggtcgtcgactatctcgcgccgctgaccgcgaacggcaactggggcggcacgctgttctcgcacccgttcgacaacgacaacacggacaactcgttccgcgtcaacaacacggtcaagtacgcgagcgccgactggaacggcctgacgttcggcggcacgtacagcttcagcaacagcacgggcttctcgaacaaccgccagtacagcatcggcgcgcagtattcgctggccgggctgcaggtcgcggccgcgtacctgcaggcgaacaacccgggcatcggcagcgcgggcgcgatcgcggccgacgacgcgaacttcgtcgccgaccggctgcgcatcttcggcggcggcgtcaattacacgttcggcccggcgacggtcggcgtcgtctacacgaagaccgacgtgaagaacccggtatcgacggtctacctgccggcgtcgacgttcgccggtctcgggctgaccgcgacgaagttccagaacttcgaaatcaacggcaagtaccagctcacgcccgatttctatctcggtgcgcaatacgtatacacggacggcaagtacgatgcggcggccggttcgttcaagccgaagtaccacacggtcggcctgatggccgactacagcctgtcgaagcgcaccgacgtgtacctgcagggcgcgtggcagaaggtgggcggcgacaagacgggcacggcggccgacggcggctatgtcgtcgggacggacggcccgtcggcgtcgtcgaaccagttctcggtgcgcgccgcgattcgccacaagttctga

SEQ ID NO: 178 - DNA, 1089 bp, Burkholderia cenocepacia
atgaacaagactctgatcgttgcagcagctgcagcatcgtttgctaccgtcgctcacgcgcaaagcagcgtcacgctgtacggcgtgctggacgcaggcatcacctaccaaagcaacgtcggcggcaagtcgctgtggtcgatgggctcgggcatcgaccaaagccgtttcggtctgcgtggttcggaagacctcggtggcggcctgaaggcaatcttcacgttggaaagcggcttcaacatcggtaacggccgcttcgcaaacggcaacggcggcatgttcaaccgccaagctttcgtcggcctgtcgagccagtacggcacggtcacgctgggtaagcagtatgacgcaacgcaagactacctggcgccgctgacggcaacgggctcgtggggcggcacgtacttcgcgcacccgctgaacaacgaccgtctgagcacgaacggcgacgtcgcgctgaacaactcgatcaagtacacgagcgctaactacgctggcctgcaattcggcggtacgtactcgttctcgaacaacacgaacttcggcaacaaccgcgcatacagcggcggtctgtcgtaccagttccaaggtctgaagctgggtgcagcatactcgcaagcaaacctgggtgacggtaccaacacgaacggcgcatcgacgctgggtggccaaggccgtgtccgtacgtacggtgctgctgctggttacgcattcggcccggcacaagtcggcgctgcatggacgcaatcgcgtatcgacaaccaagctgctggcgttccgacgctgcgcgctgacaactacgaagtcaacgcaaagtacaacctgacgccggctctcggcctgggtgctgcttacacgtacacgaacgcgaaggtcaacaacggcagctcgcactggaaccagttcggcgtgcaagctgactacgcgctgtcgaagcgcaccgacgtgtacgcacaagctgtgtaccagcgtggcgcgaagggcaacaacatcgttggcacgggcatctacaacggcgacaacacgacggcatcgagctcgtcggtcaaccaaaccgcagcaacggttggtctgcgtcaccgcttctaa

SEQ ID NO: 179 - DNA, 1158 bp, Burkholderia cenocepacia
atgaagaaacttgctctctcgaccctctcgctcgccctgctgggcgcggccggcgctgctcaagctcagtcgagcgtcacgctgtacggcgtgatcgacacgtcgatcacctatgttcacggtaacgatggtcaaggtaacaattcgtggtcgatgggtagcggcaacctgcaaggcagccgcttcggcctgaagggttcggaagacctcggtggcggcctgaaggcgatcttccagttggaaaacggcttcaactcggcatcgggcgcactgggccagggtggccgcatgttcggtcgtcaagccttcgtcggcctgcaaagcgaccagtacggtacgctgacgctgggtcgccagtacgacccgctggtcgacctggtccaggcagtcacggctgacaactacttcggcagcgtgttcgccacgccgggtgacgtcgacaacaacgacaacagcctgcgcgtcagcaacgcgatcaagtacacgtcgccggtctgggcaggcctccaggtcgaagcgctgtacgcactcggcggcgtcgccggctcgaccggcaagggtcagacgtgggcggcagcggcagcgtacaacaacggcccgctcggcctggctgcaggttacttccacgcgaacaactcggctccgctgagcgcagttggccagcgcaccggctgggccggcacgtcggacgcgatcttcgacggctcgggtaacttcatcaacaacgcgtacacgtcggcatcgtcgatcggcatcgcgcaagttgctggccagtacgcattcggcccggtgacgttcggcctcggctacagcaacgcgcaatacaaggcggatgcgaactcgggcttcggcacgaaccagaagtacaacacgggtcgcgcattcgtcacgtaccaggcatcggcaccgctgctgctgggcgtcggccacatctacacgaagggcagcggccagacggacgccaagtaccaccaggtttcgctcggcgcggactactcgctgtcgaagcgtacggacatctacctggttggcgcgtaccagcacgcaagcggcaagaacgccgacggtaccgatgcgcaagcgtcggtcggctcgtacggcatcgccggcaagagctcgcaggaaatcgtcgcactcggcctgcgtcacaagttctaa

SEQ ID NO: 180 - DNA, 1461 bp, Burkholderia cenocepacia
atgtttgcgctgaatgcacgtggcgcgctgcgggcaccgctcgcgctggccgccgcgctcgcgctcgccgggtgttcgctcgcgccgcgttacgagcgtccggccgcgccggtgccggcgacctatacgccggtcgacggcggcacgacgccggccgccgaaccggccaccgcgcaggatgccgcgctgctcgacgactggcatgcgtatttcaccgatccggcgctgcaggcgtggatcgacgcggcgctcgcgaacaaccgcgacctacggatcgccgccggccggctcgaggaggcacgtgcgctgtacggcgtgcagcgcgcggaccggatgccgtcggtcgatgcgaatctcggctatgaacgcgcgcgccagtacgacccggtcgtgcgcgaaagcgcgatcagcgggctgtatcgcgcgggtgtcggcgtcagcgcgtacgagctcgacctgttcggccgcgtgcgcagcctgtccgaggcggcgctcgccgactatttcgcgacggccgatgcgcagcgcacggtccgcatcggcgtgatcgccgaagtggcgggcgcatacgtttccgaacgatcgttgcacgagcaactggcgctcgcccagcgcacgctcgatgcgcgcgagcggatggccgcgctcacgcaacgccgctatgccgccggcacgagcgacgcgatcgagctgcgttcggccgagatgctggtggcgtccgcgcgcgcgtcgcaagccgcgctgcagcgcgagcatgcgcaggccgtccgcgcgctgcaactgctggcgggcgatttcgcgcgcaacgtgcccgacgacgcgaccgcgcttgacacgctgtcgatcgcgcccgtggcgccgggtgcgccgagccagttgctcgaacggcggccggacatccggcaggccgaggggcggctgaaggccgcgaacgcgaacatcggcgcggcgcgcgcggcgttcttcccgcgcatcgcgttgacgaccgactacggctcggtgagcgacgcgttctcgaacctgttcgcggccggcacgagcgtatggacgttcgcaccgcgcatcacgctgccgatcttcgcgggcggacgcaatcgcgcgaacctcgacgttgcgcacgcgcgcaaggacattgcggtcgccgaatacgagaaggcagtgcagaccgcgtttcgcgaagtggccgatgcgttcgccgcgcgcgactggatcgaccggcagctgaccgcgcagcaggacgtgtatgcggcggacggcgcgcggctgaagctcgcggagcgtcgttatgcgggtggtgtcgcgacctatctcgaactgctcgacgcgcagcgcagcacgtacgagtcggggcaggagctgatccggctcaggcagctcaggctggcgaatgcgatcgcgctgtatcgcgcgctcggcggcggctgggcgccggccacggcggaggccgcggcttccgcgtga

SEQ ID NO: 181 - DNA, 1524 bp, Burkholderia cenocepacia
ttacccgttcgtcgccgttgccgacgcgggcgcaggagccgccgccttgtcgtagtcgaccggcgcatccggcgcgcgcggcgcttcgccggcatgctggatccagccgccgccgagcgcgcggtacaggtcgaccaggttcgtccagcgcgccaggcgtgcgctgatcagcgactgctgcgccgagtacagatccgtctgcgcagtcagcaccgacaggtagctgtcgacaccgttcttgtaacgcaggtccgacaggtcgaagcgacgttgctgcgcgtgctcgttgcgctcgagcgccgcgatctgctggtcgtacgtgccgcgtgcggcgaggccatccgacacttcgcggaatgccgactggatcgccttctcgtagttcgcgatctcgatgcgcttctgcacgtgcgcgagatcgaggttcgcgatgttctgcccgccctcgaagatcggcagtgcgatgctcggcgcgaacgaccatgccgccgtgccggccttgaacaggccgcccagcgtcgggctcgcggtgccgaacgcgcccgtcagcgaaatcttcgggaagaacgccgcgcgcgccgcgccgatgttcgcgttcgcggccagcagcgtctgctcggcctgcatcacgtcaggacgacgcgtcagcagatccgacggcaggccagcgggcacgtccgtcagcaggttctgcgcatcgagcggcatgcccgccggcaggtcgtccggcagcggctcgccgatcagcagcaccagcgcgttcagcgcctgcgcgcgggcacgggcctgcgcctgctggttcgcgagcgccgtctcgacgaccgtctgcgcctgacgcagctcgagctccgagcccgtaccgttgtcgaactgcagcttggtcaggtcgtacgatgcctgcgcggtcttcagcgtgtcctccgtgaccttcagcaggtcgtcggtcgacagcagcgtcaggtattgatccgccacctgcgacaccagcgagatctccgacgcctgccgcgcatacgcggtcgacaggtattgcgcgagcgcctgatccttcaggctctgcacgcggccgaacaggtcgagctcccacgacgcggacaatccaacgttataggtgcgcgaaatcagcggcgccctcgtcgtcgacacaccggccggcagacgctggatgttgcccgtgcccgtaccgtcgagcgtcgggaacagccccgcacgcgtgatctggtactgagcacgcgccgcctcgatattgagcaccgacacgcgcaggtcgcggttgtttttcagcgcgatctcgatcagccgctgcaggcgcggatcgacgaagaactcgcgccagccgatggcagtcgccgcctggccgttcgcgctgcgcgcgccggctgcgcccggctgcgtcgcgtagacgccgccggccgggtacgcctgcgcgacgggtgcgtcgggccgcttgtagtgcggcgccatcgtgcagcccgtggcaaagagcgcgactgcgattgcagtcaaagcgtgtttttgcatcat

SEQ ID NO: 182 - DNA, 477 bp, Burkholderia cenocepacia
ttactcggccgaacccatcatcgtttgctgatagttctgcaggccgaccttgccgatcaggtcgatctgcgtttcgagccagtcgatgtgctcttcggtgtcgtcgaggatcttctcgaagatctcgcgcgacacgtagtcgcgtaccgattcgcagtaggcgatcgcttccttgcaggtggactgcgagatctgctcgagcttcaggtcgcacttcaggatctcttcggtttcctcgccgacgagcagcttgtgcaggtcctgcaggttcggcaggccgtcgagcatgaacacgcgctcgatcagccagtcggcgtgcttcatttcgccgatcgactcgtcgtattcgtgcttgccgagcttgtcgaggccccagtgcttgtacatgcgcgcatgcaggaagtactggttgatcgccgtgagttcattcttcagttgggcgttcagatattcgatgactttcttgtcgccttgcat

SEQ ID NO: 183 - DNA, 237 bp, Burkholderia cenocepacia
tcaggccgccttgcggtcgtagaacgtgaccgggatcggatgagcatgatgctcgacaccgcaccggctcgcgcagacgccttgctcggccatgaggtcgcgtacggactcctcgcacttgccgcagcacgtggccacgccgagctcgaactggagttcatcgaaagagttcacgccctcggcgagggacgcgcgaatcttgcgatcggaaacagacttgcacacgcagacgatcat

SEQ ID NO: 184 - DNA, 933 bp, Burkholderia cenocepacia
tcatgctggcctcacttgaaccggatggtcgggttgatgaccgcgtacagcacgtcgacggtcaggttgatcaggatgaattccagcgagaacagcagcacgatcgcctggatcaccgggtagtcgcgcatcgtcaccgcatcgaccagcaggcggccgagccccggccagttgaacacggcctcgacgacgatcgagccgccgagcaggaagccgaactgcagcccccatcatcgtgacgaccggaatcatcgcgttgcgcaggcaatgcttgagcacgaccatcggctcgtgcacgcccttcgcgcgcgcggtgcgcacgaagtcctcgttcagcacctcgacgaacgacgcgcgcgtgaagcgcgccatcacggcggcgaccgcggcgccgagcgtcagcgacggcagcacgtagctcttccacgtgccgtccggcacgaccggcagccagccgagcttcaccgagaagatctccatcagcagcatgccgagcgcgaacgcgggaaacgaaatacccgacaccgcgatcgtcatcccgagtcggtcgggccagcgattgcgccacacggccgacgcgatcccgatcgccatcccgatcgccgtcgcccacaccatgctgacgagcgtgagcagcagcgtcggcatgaagcgctccccgatctcggtcgacaccggccgcttgctgcgcgtcgagatgccgaaatcgccgtgcgcgatcttcacgaagaagttcgcgaactgggtcggcatcggcttgtcgagcccaagatcggcacgcacgagcgcgaccgtcgcgtcgtcggcttcggggccggccgcgagccgcgccgggtcgccgggcagcaggtgcacgaacaggaacaccagcaccgcgacgatcgcgagcgtgggcagcaggccgaacaggcgtttgacgaggaaattcagcat

SEQ ID NO: 185 - DNA, 1221 bp, Burkholderia cenocepacia
ttagaagcggtggatcatgccgacgccgacgccgatctggttctgcttcgaacctgcgcccacgccgtcaccgatcgacgtggtcgccgagatgattgcgttgccgcggccgttcagcgtgttgccgcttgcgtgctggtaagcctcaaccgcgtacaggcccgtgcgcttcgacaggctgtagtactgcgacagcgtgacctggtggtacttggccgagctcgtgatgccgttcgactgcgttgcggccgtgtacgagtagcctgccgcgaagtcccactgagcagctgccttccagtgcagcacggcgccagccgtgttgaagattgccttgttccggaagaacgaacccgtgcccggcgtgtactggacgttcgagtacgacgccgaaatatcccatgccggcgtgaactggtagcccgccgtcacggcgatacgctgctgcgattgcgcggtcgcgtagccgttgttgatcgacgagactgccggctggttgccgtcgcccgctgccgtcaggccgttctggaccgtcgagttcgcgccccacacgccgccgccgagcgtcgagttgttgaccttctgatagccgaccgcgatgcctgccgggccgttcaggtactggatcgccgcgctccacgtcgagccgcggttcgtcgcgcctgcgacgccgccgaacgagtacgaaccgccgaccgtgaagccgtagaacttcggcgacatgtagacgagcgagttgttcgcgcggtagctggtatccagcgaatcgatatcgcccgggtgcgcgccgtagtagccggtcagccaggtcgtcgggctgtacggcgacagcagcgtgtagtacgcggtgtactggcggccggccgtcagcgtaccgtacgtggcgttggtcaggccaacccatgcctgacgcgtgaagatgccgttggtccactgcgacgagccgttagccgtgttgacgccggcttccaactggaaaatcgccttcgtgccgccgccgagatcttcgctgcctttcaggccgaagcggctgcctgcccacacgccggtggacatctgcaccttcgagtgaccacccgaggttgcgccgactgccgacgagttgttctgccaagcgataccgttgtcgacgataccgtagagggtcacgctgctctgggcgtgggcggcggtagcggctgcgagaccgactgccgtcatggcgaaagcgacgcgctttttcat

SEQ ID NO: 186 - DNA, 2373 bp, Burkholderia cenocepacia
atgtcgttcacctttgccgcgcggccctcgcgcggccggctcgcgctcgcctgcgcggccgctttcgcatggccggccgcttacgcggctgccaccgacgatgtccgcgccgggaccgcccgcggcggtggcgtcgatcgtcccccgaccactgcgaccgccgcgccggctgccgccggcgtcgcggcagcgtccgcaccggccggcgatacgctgagcgccgtcagcgtgaccgcgcagcggcaaccggtcgacccggatacgccggccgtcgtcacgtcaattacgcgcgagcagatcgatgcgcataccaacgtcaccaccgaggacgcgctgaagtacgcgccgaacctgatggtccgcaagcgctacatcggtgaccgcaacagcatattcgcgggtcgcgacttcaacgaactgcagagcgcgcgcgggctcgtctatgcggacggcgtgttgctgtcgaacctgctcgggtcgagctatgcatacccgccgcgctggtcgctgattccgcccgacgacatcgcgcgcgtcgacgtgctctatggccctttttccgcgctctatccgggcaacgcgatcggctccactgtgctgctcaccacgcgccgcccggaacaactcgaggcgtcgctgtcgacgcagttctttacgcagcgctaccacgacggctacggctttgccgacagcttcggcggcaatcaccagacggcgcggatcgcgaaccgcgtcggccggttctggttcgcgttgtcgctcgaccggctggagaacaacggccagccgatgcagtacgcgggccccaattcgacctacaacccgaaactgggcgccgccgtgccggtgacgggcgccgcgaccgacatcggccccaacggcaagccgcggaccatcgtcggcgcgcagacgatcgagcggaccgaacagctcaacgagacggtccggatgggctatgcgttcaccgatcacgtcgatgcgacgctgacgctggggcattgggagaaccattaccggcagcacggcgagaccttcctgcgagatgcggcgggcaatcccgtctacggcggcaacgtgtcgatcggcggccagaacatgacggtcgcgccgaacgcgttcgcgccgcagcgcggcgaccaggagaactggctgtacgcgctcgggttgaacggccggctcgattccggctggcggctgtcaggcgtcgtgtcggcgtacgacgtgtcgcgcgacgtgctgcgcgcggcctcgaccgtgcagggtggggcgggcacgctgttccagggcgacggcaccggctggcgcacgctcgatctgaaggccgaggcgccggtagtgaaaggtcatacgttcacgttcggctatcactacgacaactacttcctgcgcaacgtcacgtacaacacggccgactggctggccggcccgaccacgtcgctcgcgagcgtctatcgcggcgacacgcgcacgcaggcgctgttcgggcaggacgcgtggcgtttcgcgccgcgctggctcgcgacgctcgggctgcgctacgagcgctgggatgcgtatggcggcgcgctcggcaatgcgcgcggcacgctcggctatgcggaccgcggcgcgaacgcgctgtcgccgaaagtcgcgctgcagtgggacgcgacggaggtctggcgcttccggctgtcgttcgcgaccggcacgcggttcccgacggtcggcgaattgttccagggcacgatctcgaacaacgcgatcgtcaacaacaacccgaacctgcggccggagaaggcgatcgactgggacttcacggccgaacgcgacgtgggcgtcggcgtcgtgcgcgccagcgtattccagagcgatctgcgcgactcgatctacagccagacgacggtgtcgggcgcgaccaccgtcaccaacatctcgaacgtcgaccgcgtgcgcgtgcgcggcgtcgaactcgcgttcagcggcgagaacgtcggggtgcgtgggctcgatctcgacgcgaacgtatcggcgagcaacgcgcagatcctcgccgatgccgcgaacccggcctacgtcggttcgcgtttcccgcgcattcctcgcatgcgcgcgaacctgctcgcgtcgtatcgcttcgacgagcactggctcacgagcgtcggcgtgcgctactcgggccgccagttcaacacgctcgacaacagcgacgtgaatccggacgtctacggcggcacgagttcgttcacggtcgtcgatctgaaggcgcgctatcgcttcgatcgtcactggaccgcgtcggccggcatcgacaacgtgacggaccgccgctactacacgttccacccgtatccgggccgcacgttctatggagaactgaaatggtcgctgtga

SEQ ID NO: 187 - DNA, 2229 bp, Burkholderia cenocepacia
tcagaacgtggtgcgcaatccggccatcaggcttcggccgccttgcggggcgaagccgcgcacgaccgacgtcgagtagcgaatctcctggttcgtcaggttgtcgccgcgcaggtgggcgagccagtgcgtcgggccgacgcggaatttgtacgtcagcatcacgccgagcgacgtatagccgtccgtcgagaagtcgtcgtcgggcacgcgatgctgcgaccacgcgtgcgtgacctgtgcgcgcgcaccgaacgggccgtaaccgtagtcggccgcgagcgtcgcgcgcagcggcgcgatgcgcggcagcggctgccccgtgtcgacgttgcgcgcgtgcgtgtagtcggccgtcagttcgagatcgaccgtgtggccgcgccgcgagaacgcacgccacttgccgtccagctcgacgccgtagaactcggcgcgcacgccgcggtagatcgcctcgttgagcgagccgtcagtgccgggcgcgacgggctcgccgtcgtcgtccaccacgcggccggtgttgtactcggtcagatagttcgagaagcggttgtagaacacgccgacgctgccgcggttcggcccgctcgcatagcgcagcgacaggtcggtcgacacggccttttccttcgacgcgttcgggttgccgatcaggaactggccggtcgcatcgtgcgggccgttcgaatacagctcgtagaaggtcggcgcgcgttcggtgtaggcgacgttcgctgcgatcgaccataccggcgtcagcgagaacagcgcaccggccgacaggctgcccgcattgaagtcgcgcggctgcgcgcccgcgaatttctcgacgcccgccggatcgggatcgaccttcacgtgctcgaagcggccgccgaggctcagcttcagcgccgggacgacctgccattcctcgaggccgaacagcgcgacgctgttggtgcgggtggacggcacgagcatttcgtcgccgagcgccgagaacgtgttctggccgaactgcacgccgatcgcgccttcgaacggcccgatcttgcgatggcgtgcctcgatgcgcgcctcgtaaccgcgattgcggaaggtggtcgccgtctcgccgttgtccacttccttgtggcggtagtcggtgtacgcgaaatcgaatttcagcttcgtgaacggcccgctcaggttgcgcacctcggacgcgaacgcgaggcgttcctggcgcatccgcagccgcacgtcgctttccgcgacggagccgtagttcgattcgtagccgctgtacgacaggcccgcgaaaccgtccgcccacgtgtacgacgcgccgaccgcaccgccgtgcacgcgcccgtcgctgttcggcacgttgccttccggttgcggcgcgtcggggccgtcgatcgcgcgctgctggctgctgcgcgcatagccgggaatccgcagcttgctggtttcgcgatcgaacgcgtcgacgtggaacgcgaagcggccgttgccgccttcgacctgcgcggcgccggcgcgcacggaattcgcgccgccgtagcgggcgtcgagcgcgcccgtcatgccttcgatcgcttcgcgcggaatccggttgtcgatcgtgttgaccacgccgcccaccgcgttgccgccgtacagcagcgcggccgggccgcgcacgatctcgacgcgctcgatcgacagcgggtcctgcggcaccgcgtgatcgtacgacagcgacgacgcgtcatacgctgcgacgccgttctgcagcagccggatccggtcgccgtccatcccgcggatgatcgggcggccgaccatcggcccgtaggtggtggtcgacacgccgggcagcccgttgagcgtttcgccgagcgaatcggcctggcggcgcgtcagcgcgtcgccggaaagctggacggtcggtgcgatcagttcggtgtcgccgagcgggttcgcggtcacgaagatcggcgcgagcggtgcgggtgcggcggcaggcgtgccggacgcggcgggcgcatcggtctgcgcatgggcgacggcggcgcacagcatcagcgacagggacgagagcgggcgaagcggtaagtgagggaggtcgcgcatggtcggtgaatcggttggaatcggatgatcggataacgagcgatgcgggtcactgttagatacgatatattgttgcgtaactgacgcgcagtgacccgttggaacatggctcggcaaggcgcggccacctggttggaacggcat

SEQ ID NO: 188 - DNA, 1275 bp, Burkholderia cenocepacia
ttattgcgcgctcgacgcggcggcagcactcgccggcgcggcgcccgatgcggcggcaccggaagcggcagcggcgccggacccggcagcggccggcgcggcgggggcagcggcacccgaggcggcatcggccgccggggcgagctgcgcggcgacggtcttcacggtcgcgcccgggcgcaccttgtcgacgccttgcacgatcacgtgatcgcccgcctgcagaccgccttcgacgatccagttctggccttgcatgccggtggtcttcagcggacgcggctcgaccttgttgctggcgttcaccaccatcgcgatcgcctggcccttctggtcatgcgtgacgccgatctgcggcaccaggaaggcgttctcgttcacgccttcctcgatccgtgcgcgcacgaacatccccggcagcagcacgcggcccgggttcgggaacaccgcgcggatcgtcaccgagccggtggtctggtcgaccgtcacgtccgagaactgcagcttgcccggctccgagtaggtcttgccgtcttccaggatcagcgacaccttcgccgcgcccgggccgctcgtcttcagacggccgctctgcacgtcctgacgcagcttcagcccttcgaggctcgactgcgtgaggtcgacgtacaccggatcgagctgctgcacggtcgacatcagcgtcgcctggctcgcctgcacgtatgcgcccggcgtcacttgcgagatgccgacgcggccgctgatcggcgacacgacgtccgtatagccgaggttgatctgcgcggtatcgaccgccgccttgccggccgcgacgtccgccgcggcctggccttgcgtggcgaccgcgttgtcgtagtcctgcttgctgaccgcgttcgcggccaccagcaccttgtagcgcgcgaccagcgcgttctgcgtgacgaggttcgcctgcgccttcgcgagcgtcgccttcgcgctgttcagcgccgcgatgtacggcgccggatcgatcttgtagaggcgctgaccggccttgacgtcggtgccttcggtgaattcacggcgcagcacgatgccgtcgacccgcgcacgcacttgcgcgacgaggaatgcactggtgcggcccggcaggtcggtgaagaccggtacggcttgcggctggacggtgacgacgccgacttccggcgtttgcggcggcggtgccgattcttttttcccgcacgcggccaggaaaacggcggccgtcgcgacagtgattaagcggtatggaacccgttcgacgcgcat

SEQ ID NO: 189 - protein, 734 aa, Burkholderia multivorans
MDWATGTRLRAIAAAASVAFGAAAAGQAFAQTTPAANAQAAAPNAASAGTLPAITVNAASEGDGTVGLVAKRSRTGTKTDTPIEEIPQTINVVTAQQIEMTGATDVNTALRYVPGFSSYGSDNRSDWYAALRGFTPTAYVNGLQVPNTLNLSSWRVDPYMIDSITVLRGPTSVLYGAGDPGAIVDVKTKLADGERVREAGVEIGNYARKQFMIDVGDKLDPDGKYAYRFVGVARDGNAVTGPNNDQRVALAPSFRWRPNADTSLTLSATYLQDWGDISSNFLPAAGTVLPNPNGQITKDIYEGDGNFNYYRKKQWSLGYQFEHNLNSMWTFRQNTRWMHLSVDNGSVWGAGFADETLTEINRWAGVFQMNYSRFDIDNNLEGRFATGPLQHTLLLGFQYNRQTATDSEWLAAAPTLNLYNPVYTPVTTAVFSDPDTTYRTNTYTTMNTFGLYAQDQIKWNRWTLTLGGREDWVNMRMDDRAAGTQSKADVSAFTGRVGLTYQAGYGLSPYISYSTSFNPIIGVSLLDGGVPKPTRGRQIEAGLRWQPPGKNLMLNAAIYQINQTNGVTPALPTQDPGGTKSVQTGEVRARGIELSATGKVTPNLSLIASYAYQDVKVVQANDATLNNWPVDIPRPRQMASLWADWTWHTGPLAGFGLGGGVRYQSASAGAADNSLTVSSYTLIDAAVHYDVRNWRFAVNATNLFNRHYISGCQSTSVCMFGNDRTVIATAKYNW

SEQ ID NO: 190 - protein, 517 aa, Burkholderia multivorans
MLEDNKMDNMHNTNGLMRIAKVAAASTLLATLLAACAVGPDYKRPDVTTPAAFKEAPTLAPGEQAGTWKPAEPADGAHRGEWWKVFGDPVLDALEEQALAANQNLKAAAARVEEARAATRTARSQWFPQVGVGFGPTREGLSSASQFQPQGTGPTNATLWRAQGTVSYEADLFGRVSRNVEASRADQAQSEALFRSVQLALQADVAQNYFELRQLDSDQDLYRRTVELREEALKLVQRRFNEGDISELDVSRAKNELASAQADAVGVARRRAASEHALAILLGKAPADFAFKETPLVPVAVKIPPGLPSALLERRPDVAAAERAMAAANARIGLAKSAYFPKLDITGSFGYEASTLGNLFLWSSRTFLLGPFAGTALTLPLFDGGRRAAGVQQARAQYDEQVANYRQQVLVAFREVEDNLADLRLLDDQIRAQNAAVNASRRAATLSRTQYQEGEVAYLDVIDSERSVLQSQLQANQLTGAQAVSTVNLIRALGGGWGEAPTAVDGAAAAKAEIAGR

SEQ ID NO: 191 - protein, 748 aa, Burkholderia multivorans
MKSRSDESKLGKFTTLCSVLAAGPAFAADGAPPPAPADAEGHLAPIEIKGRAEHSYKADFSASAKFTAPLVDTPKSVTVIPQELIQTSGASTLTEALRTVPGITFGAGEGGNPLGDRPFIRGYDTQGSMFVDGMRDTGATTREIFNTERVEITKGSDGAYGGRGGAGGSINLITKAPHLGTTAAASAGLGTDRYRRFTADGNWQFADHAAFRLNLMSHNNDVAGRDAVNNERWGVAPSIAFGLGTPTRVTASYYHLSTDDLPDGGIPYFYTTTNKPANVDTIYPAPVDRHNFYGLIDRDFRKTTSDISTLRIEHDITPALTVRNTTRYTESTQDYIWTQPDDSQGNVINGKVWRRNNNRNSSINSIANQTELFGEFRTGPFKHSFTTGIELSREWGKRDTYTVATGTGAICNNGIGAPSGYNCTSLWSPNPADPWAGSISRNNDYAHARTTTKSIYGFDTIELTPRWQLNAGVRVDDYSTRFTDTKANGGKTYTRDDTLFNWQLGAVFKPAQNGSIYASYATSSTPAGMLLGEGSETQSLTPGRGGVGSNADQLSPEKNRSIEVGTKWNVLNDKLSLTAALFQIDTTNARVTLPNNQYAMVGNKRVQGLELGVAGQLTKQWQVFGGYTYMKSELRDNGKDTANNGHRFPNTPKHSFTMWTNYDVTPKFTVGGGAFYMSEVFGDPANLRAVPSYWRFDAMAQYRINKKLDLQLNVNNLFNRTYFDQAYPAHYASIAPGRSAFVTLNARY

SEQ ID NO: 192 - protein, 755 aa, Burkholderia multivorans
MHRSTLARQPIFAALIGAVGLSAATAHADSSPSHTAASSVTADAAAARASSALLDPVTVTATRTATAASRTAASVSVIDADDLDEQQATNIKDALRYEPGITVRRTAYRPGNAALGGGRDGDSSINIRGLEGNRVMLMEDGIRLPNAFSFGPLEAGRGDYTDLDTLKRIEIVRGPASALYGSDGLTGAVNFITKDPQDLLSIYHKPTYFSFRPSYDSTDRSIGATVSAAGGNDRIQGMIIADGRRGHEIDTRGSNNSAGKLRTTSNPQHVYSESLLGKLVLTPTVRDTIRLTAETVQRRVGTDVLSAIVAPATLGLTTSDRLERNRFSADYAFHDDASRWLQNAHVQFYYQEATQDQYAFETRGTLPSRSRDNRYRERTFGGSAFAESGFSTGPLAHKLLGGVDGSLSRITNLRDGTVPGVGETFPNKAFPDTDYTLFGAFVQDQIGYGRLLVTPGLRFDTYRLKPSGNDPLFTGRAVSTHANELSPRVAVLYEIAPALIPYLQYAHGFRAPTPDQVNSSFSNPVQGYTSIGNPNLKPETSDTFEAGLRGRAGTGYGTIRYSAAAFTGRYRNFIARTTIAGSGRPTDPFVFQYVNFADARVHGIEGRADWAMPNGITLRTALALTRGSTQNDGAASQPLNTVNPFSAVFGVRYEPTERWFVQTDLLFQAAKRDKDIDRSDCSKRACFAPPSSFVVDLRGGYRFNKHVSATVGIRNLFDRKYWNWSDVRGIAADSPVLDAYTSPGRTVAVSMKVDF

SEQ ID NO: 193 - protein, 713 aa, Burkholderia multivorans
MTIFSLRTPPASPSACARPAPRMLKLAVPALTAGVLSATAAAADADAPAHRADVPPDTPGMLLLPVEVVASPLSTPLVVVTDPKAPRQPLPASDGADYLKTIPGFTSIRSGGTNGDPVLRGMFGSRLNVLANGMPTLGACPNRMDAPTSYIAPESYDKVTVVKGPQTVLYGPGASAGTVLFERTTPRFERPGMRFDGSVVGGSFGRNDQNVDVTAGTPDFYGRVIANHAHAQDYRDGNGRTVPSQWDKWNADAALGWTPDVHTRVELTAGTGDGYARYAGRGMDGAHFRRDTFGLSFDKRHLGDVLDRIEARVYYNEADHVMDNYTLRQPDPASSMPMRMASEVRRRTLGARAAATWRFGDAFKLVTGVDAQSNRLDSRAAMGRQNYGDQPWDAQATMWNAGAFGELTWYAAEAARVIGGARVDYASARDKRATTGGMMTSRPNPTFDDDRARVLPSGFLRYERDLASLPVTWYAGIGHAERYPDYWELFSAKRGPAGSVNAFSAVQPEKTTQLDIGAQYKSDRLDAWVSAYAGYVQDFILFDYASGMMGPTTRASNVNAQIMGGEAGVGWRPVAPLRIETSVAYAWGRNATSGDPLPQMPPLEARVGLEYTRGAWSAGGLWRVVAPQHRYAVNEGNVVGKDFGPSAGFGVLSLHAQYNVSKTVQISVGVDNLLNKAYAEHLNLAGNAGFGYPANAPVNEPGRTAWVRVSAKL

SEQ ID NO: 194 - protein, 863 aa, Burkholderia multivorans
MGNESRTGPSFTDFSIMVSIRLMPRRRPASARHTRRTIVPAAPNRVAHRLAGAVLLSALLPLPALADADTDAAAAAPRTSRRAFDVPAGPLEATLNRFGRDAGLLIAFPPELTAGLSSGGVHGRFDVDDALARVLAGTGLVALRQSGGGYTLMRANGANGANGMSGAAVPAPSADTAAELPTIAVRSSALRAQSYRPPKEAGVLRADIPVLDTAQAVNVVPAQVLRDQRPRNLDDALGNVSGITQGNTLAGTQDTIMKRGFGDNRDGSVMHNGMPIVQGRSFNAAVDSVEVLKGPTSLLYGLMDPGGVVNVVSKQPQLTRYNAVSLGASTFGHGKNGGSATFDSTGPIGDSRLAYRLIVDQSNEQYWRNFGEYRQTFVAPSLAWYGRDTQVVVSYEYRKFHSPFDRGTALDPRTNAPLDIPARRRIDEPFNNMDGESHLAQLSVDHQFNADWSAHFGYSYNRETYDANQLRTTGVDPVTGTLSRSNDATHGSLSTDSYGIGYVNGKLTLAGMRHDVQVGFDTEYRRIYRKDMLRQAVKTPFSYVDPVYGLLPPSSTVSASDSDQTDALHDASAFLQDTIHLTDKWIVSGGVRYITYNQVAGRGRPFHANTDLSGSRWLPRAGIVYKWTDSFSLYGSYSQSLKPSSSIAPMASGYVIDAATPPEQATAWEVGGKLDLPGGITGTLALFDIDKKNVLVSQFNDATKLTDWRTSGKARSRGVELDVSGRIGERVNVIASYAYIDAKTIEDPLYAGNRLWNVARHTASLAAVYDVGTLAGGDDLRIGAAARYVGARPGDSANSFTLPSYVLADAFATYDTRLGKQKLSFQLNVKNLFNRTYYPSSANRYFVAIGDARQVSLLTTLQF

SEQ ID NO: 195 - protein, 214 aa, Burkholderia multivorans
MNMKIATRLSVFALAGALLAGCATQQGNNTAVGTGTGAALGAGIGALAGGGKGAAIGAGVGALVGGVTGYNWQAIKNKLAPSAAQTGTQVTEQPDGSLKLNVPSSVTFATNQYAITPAFTPLLNDLATTLNQNPQVTASVIGYTDSTGSAQLNQTLSQNRAQSVVNALVQRGVAGNRLSAQGMGPSNPVADNSTEAGRAQNRRVEIYLRAPQHQ

SEQ ID NO: 196 - protein, 176 aa, Burkholderia multivorans
MTTRRVTMMSKKVRLALAVMMIGALAACKSGVKLDDKANAGAMSTQPSADNVAQVNVDPLNDPNSPLAKRSIYFDFDSYSVKDEYQPLLQQHAQYLKSHPQRHVLIQGNTDERGTSEYNLALGQKRAEAVRRALALLGVADSQMEAVSLGKEKPQATGHDEASWAQNRRADLVYQQ

SEQ ID NO: 197 - protein, 222 aa, Burkholderia multivorans
MNKLSKLAFIAATAVMAASASAQSVPASRQAVNDNWVNGTGEWVWMNGTNELCWRDAFWTPATANAKCDGALVAQAPQPPVAPVAPAITSQKITYQADALFDFDKATLKPLGKQKLDELASKIQGMNTEVVVATGYTDRIGSDKYNDRLSLRRAQAVKSYLVSKGVPANKIYTEGKGKRNPVTTGCNQKNRKQLIACLAPDRRVEVEVVGTQEVQKTTVPAQ

SEQ ID NO: 198 - protein, 379 aa, Burkholderia multivorans
MKKTLIFAALSGACAAAHAQSSVTLYGLIDAGITYTNNQGGHSAWQETSGSINGSRWGLRGTEDLGGGLKAIFTLENGFGINNGTLKQNGREFGRQAFVGLAHSGFGSLTLGRQYDSVVDFLGPLSLTGTQYGGTQFAHPFDNDNLNNSFRISNAVKYQSADFGGLKFGALYGFSNSTDFSNNRAYSVGASYSFMGFNVAAAYMQLNNNINSLALAASDPGAVAGDWTFAASRQRTWGAGLNYAFGPATAGFVFTQTRLTDSAGISAGQSGVSGGIPLTGDTRFNNYELNARYALTPAFSLAGSYTYTDGRMEGQKPSWHQFNLQADYALSKRTDLYLQGEYQRVNGDGLAVGANINGLGVASSTNKQIAVTAGMRHRF

SEQ ID NO: 199 - protein, 384 aa, Burkholderia multivorans
MRKHVIFAAALAAFAAPAFAQDSVTLYGVIDEGFNYTNNVSVNGAGKADYQLASGYAQGSRWGLKGSEDLGGGLKAIFTLESGFDVNNGRLGQGSRMFGRQAFVGLGTSRFGTLTFGRQYDSVVDYLAPLTANGNWGGTLFSHPFDNDNTDNSFRVNNTVKYASPDWNGLSVGGTYSFSNSTGFSNNRQYSLGAQYSLAGLQVAAAYLQANHPGAGGAGAIAADDANFVAERLRVFGGGLNYTFGPATVGFVYTKTDLKNPVSTVYLPASTFAGLGLGATKFDNFEVNGKYQLTSAFYVGAQYVYTDGKFDAATGSIKPKYHTVGLMADYSLSKRTDVYLQGAWQKVAGDRTGTAADGGYVVGTDGPSSSSNQFAVRAAIRHKF

SEQ ID NO: 200 - protein, 363 aa, Burkholderia multivorans
MNKTLIVAAAAASFATVAHAQSSVTLYGVLDAGITYQSNVQPAPGQAGKSLWSMGSGIDQSRFGLRGSEDLGGGLKAIFTLESGFDIGNGRFRNNGGMFNRQAFVGLSSQYGTVTLGKQYDSVQDYLAPLTATGSWGGTYFAHVGNFDNLSTNGGYSPNNSIKFTSANYAGLQFGGTYSFSNNTNFGNNRAYSGGVSYQFQGLKIAGAYSQLNNPGQTTGGAVDTLQTQGRVRTYGAAAGYAFGPAQVGAAWTQARLDNTGATGTSVRIDNYEVNGKYNLTPALGLGVAYTYSNARLGQDSAHWHQVGLQADYALSKRTDVYAQAVYQRASGANASIYNGNIDTLPSSSINQTAATVGLRHRF

SEQ ID NO: 201 - protein, 386 aa, Burkholderia multivorans
MKKLALSALSLALLGAAGAAQAQSSVTLYGVIDTSIAYVHGNDGQANNMWQMLSGNLQGSRWGLKGAEDLGGGLKAIFQIENGFNPGTGKLSAANTIFNRQAFVGLQSNQYGTLTLGRQYDPVVDLVQAVTADNYFGSFFATPGDVDNNDNSLRVSNAIKYTSPVYAGFQFEGMYGLSGIAGKPGQGQTWSAAAAYNNGPIGIAAGYFYANNPSPTTTAVRGGWGSTTSDNIVDGPINAGYVTAKSIGIAQVAAQYAIGPVTFGLGYSNAQYKPDAYSTFSSTEKYNTGRGFVTYQVTAPLLLGLGYSYTKASGNTDAKYHQVSLGADYSLSKRTDVYLVGAYQHASGTQLNTDGTTSAAQASIGSYGYAGTKSQEMVALGLRHKF

SEQ ID NO: 202 - protein, 487 aa, Burkholderia multivorans
MRHRSDSRRTARRAPFALAAALVLAGCSLAPRYERPAAPVPSAYTNGVDATHDAPSAFAPRADAALLDDWRSYFTAPALHAWIDAALANNRDLRIAAGRLDEARAMYGVQRAERMPSIDASTGYERTRQYDPVLRESAVSGLYRAGVGISAYELDLFGRVRNLSDAALAEYFATADAQRTVRIGVIAEVANAYVAERALNEQRALAERTLDARERIAALTQRRYAAGTSDAIELRSAEMLVAAARASHAALQREHAQAVRALQLLAGDFARDVRDDDTALDALTIAPVAPGAPSDLLERRPDIRQAESRLKAAHAQIGAARAAFFPRIALTTDYGSVSDAFSSLFAAGTSVWTFAPRITLPIFAGGRNRANLDVANARRHIAVAEYEKTVQVAFREVADAFTARDWIERQLAAQRDVHAADDARLKLAERRYAGGVATYLELLDAQRSTYESGQELIRLRQLRLANAIALYRALGGGWTPGTAADDA

SEQ ID NO: 203 - protein, 507 aa, Burkholderia multivorans
MMQKHALTAIAVALLAAGCTLAPHYTRPDAPVAQAFPSGGVYATQPGAAGARSANGQAATAIGWREFFVDPRLQRLIEIALKNNRDLRVSVLNIEAARAQYQITRAGLFPTLDGTGTGNIQRVPQGVSQTGAPYISRVYNVGLSASWELDLFGRVQSLKDQALAQYLSTAYARQAAEISLVSQVADQYLTLLSTDDLLKVTEDTLKTAQASYDLTKLQFDNGTGSELELRQAQTVVEQALANQQAQARARAQALNALVLLIGEPLPDDLPPGLPLDAQNLLADVPAGLPSDLLTRRPDIMQAEQTLLAANANIGAARAAFFPRISLTGAFGTASPTLGGLFKAGTAAWSFAPQITMPIFEGGQNIANLNLANVQKRIEIANYEKAIQSAFREVADGLAARGTYDQQIAALERNTHAQQRRFDLSDLRYKNGVDSYLSVLTAQTDLYTAQQALINARLARWTNLVDLYRALGGGWIERAGETPRAPDQTVDYDKASAPASASAAATNG

SEQ ID NO: 204 - protein, 158 aa, Burkholderia multivorans
MQGDKKVIEYLNAQLKNELTAINQYFLHARMYKHWGLDKLGKHEYDESIGEMKHADWLIERVFMLDGLPNLQDLHKLLVGEETEEILKCDLKLEQISQATCKEAIAYCESVRDYVSREIFEKILDDTEEHIDWLETQIDLIGKVGLQNYQQSMMGSPE

SEQ ID NO: 205 - protein, 78 aa, Burkholderia multivorans
MIVCVCKSVSDRKIRASLAEGVDSFDELQFELGVATCCGKCEESVRDLMAEHGVCASRCGVEHHAHPIPVTFYERKAA

SEQ ID NO: 206 - protein, 306 aa, Burkholderia multivorans
MLTFIIKRLFGLLPTLAIVAVLVFLFVHLLPGDPARLAAGPEADEATVALVRADLGLDRPLPTQFANFFVKIAHGDFGVSTRSKRPVSTEIGERFMPTLMLTIVSMAWATLFGMAIGIASAVWRNRWPDRLGMTLAVSGISFPAFALGMLLMEIFSVKLGWLPVVPDDTWKSYVLPSLTLGAAVAAVMARFTRASFVEVMNEDFVRTARAKGVHEPKVVLKHCLRNAMIPVVTMMGLQFGFLLGGSIVVEAVFNWPGLGRLLVDSVTMRDYPVIQAIVLLFSLEFILINLTVDVLYAVINPTIRFK

SEQ ID NO: 207 - protein, 399 aa, Burkholderia multivorans
MKKRVVVAMTAAGLAAATAAHAQSSVTLYGIVDNGLAYQNNAAPSTGATSGGHSKVSMSTGVWAGSRFGLKGNEDLGGGTKAIFQLEAGVNTATGASQWSGGIFTRQAWVGLTNAAYGTLTAGRQYTAYYTLLSPYSPTTWLTGAYGAHPGDIDSLDTSYRANNSLVYMSPKFYGFTVGGSYSFGGVPGSVNRGSTWSAAIQYLNGPAGIAVGYQRVNNSTLGGGAWGDNSTVTSGGQPAVSAINNGYATAQSQQRLGVTAGYQFTPAWDVSVSYTNVQYIPGVGSSFRNTAIFNTAGAVLHWKAAAQWDFAAGYSYTAATKSNGISSSAKYHQVTLSQYYSLSKRTGLYALEAYQHASGNTLSKAGAIQSATTQIGDGVAAGAGQNQIAVGVGMIHRF

SEQ ID NO: 208 - protein, 498 aa, Burkholderia multivorans
MKSSPLSVRAGSRRTAVAVAVAALALAGCANYIGIKSDKQIAPASQFETAQSLPAQGGHWPSLDWASQFGDPQLPKLIDEALAGNPSIAQAQARIAKASSYIESSRSNLLPKAEASYSWTRELYSANGLFPPPYGGQWYSENNVLASASWELDLWGKNRERLRTAVSQEKAAEADMQQARITLASSVARTYNSLAQLYALRDIAQREIANRESVGKITDGRVSAGLDTNVERQTARGNIATTQASLSDLDGQITTVRYQLAALLGKGPDRGLQIAAPVLNPAGDVALPDNLPADLVSRRPDIVAARWQVEAAMHDVKEAKAEFFPDVNLAAGFGFDAFGWGKFLNFTSRQAQFGPAIHLPIFDAGALRAQLKGRYADFDLSVANYNQTLISALNDVATQVAAIRAIDRQMGDAQRALDASTRAYDLAVIRYKAGLSPQLQVLTADSNRLASEQTVTNLKMRRRDMQLALIKALGGGFDATGTALAAPETAKQTRQAAN

SEQ ID NO: 209 - protein, 788 aa, Burkholderia multivorans
MLLTLAARPTRGRLALACAAAFALPGAYAASSDSAPTDPVRDPANRSARAVVPAASAASAASAEPAGDTLSAVSVTAQRQPLDPDTPAVVESMTRERIDTHTNVTAEDTLKYAPNLMVRKRYIGDRNSVFAGRDFNELQSARGLVYADGLLLSNLLGSSYAYPPRWSLIAPDDIARVDVLYGPFSALYPGNAIGSTVLLTTRRPDKLEASLSTQFFTQRYRDGYGFADSFGGNHQTARIANRIGRFWFSLSLDRLENDGQPMQYASPNASYNAKLGRAVPVTGAATDIGPNGKARTIVGAQSLERTEQINETVRMGYAFTDRVDATLTLGHWENHYRQHGDTFLRDAAGQPVYGGNVAIGGQNLTIAPGAFAPQRGDQENWLYAFGLNGRLASGWRLSGIVSAYDVSRDVLRAASTAQGGAGTLFQGDGTGWRTLDLKAEAPEVHGHAFTFGYHYDNYFLRNVTYNTADWLNGPVTSLASVYRGDTRTQALYAQDAWRFAPGWLATLGLRYERWDAYGGALGNASGTFGYADRSANALSPKVALQWDATDVWRFRLSFATGTRFPTVGELFQGTISNNAIVNNNPNLRPEKAIDWDFTAERDVGVGVVRASVFQSDLRDSIYSQTTVAGASTVTNISNVDRVRVRGVELAFSGENVGLKGLAIDANVSASNAQILADAANPAYVGSRFPRIPRMRANLLASYRFDEHWLASVGVRYSGRQFNTLDNSDVNPDVYGGTSAFTVVDVKARYRFDRHWTASVGIDNLTDRRYYVFHPYPGRTFYGELKWSL

SEQ ID NO: 210 - protein, 724 aa, Burkholderia multivorans
MKPIRGAPGSPPIRFRQTSTDSSTMRDLPRLPRLPRLPLRPLSPVSLMALAALAHAQTDTPATATSPSSSGAPLAPIFVTANPLGDAELIAPTAQLSGDALLRRQADSLGETLNGLPGVSTTTYGPMVGRPIVRGMDGDRIRLLQNGVAAYDASSLSYDHAVPEDPLSIERVEIVRGPAALLYGGNAIGGVVNTIDNRIPREAIDGPTGTLDVRYGGANATRAGAAQVEGGNGRFAFHVDAFDRETGKLRIPGYARSDTQRALDGPDTPQPVGSVPNSDGRVHGGAVGASYTWADGFAGLSYSGYESNYGSVAEDDVRLRMRQERLAFASEARNLPGPFSTLKFDFAYTDYRHKEVDNGETATTFRNRGYEARIEARHRKLGPLEGAIGVQFGGNTFSALGDETLVPSTRTNSVALFGLEEWQVDPALKLSLGGRIEHVNVDPDPAGVEKFAGAQSRTFNAGSVSAGALFSLTPVWSIAANVAYTERAPTFYELYSNGPHDATGQYLIGNPNASKEKAVSTDLSLRYASGPNRGSVGMFYNRFSNYLAEYATGRIVDSDGEPVPRGTDDALAEAVYRGVRAEFYGIELDGKYRVYAHSGHTVDLELTADYTHARNVDTGEPLPRIAPLRATLAADYGYGPFGARAQLTHAWSQHRVPADDEPTAGYTSLGVVLTYKFRVGATHWLAYLRGDNLTNQDIRYATSVVRGFAPQGGRSVMAGLRTTF

SEQ ID NO: 211 - protein, 431 aa, Burkholderia multivorans
MRVERVPYRLLTVATAAVFLAACGKKESAPPPQTPEVGVVTVQPQAVPVFTELPGRTSAFLVAQVRARVDGIVLRREFTEGSDVKAGQRLYKIDPAPYIAALNSAKATLAKAQANLATQNALVARYKVLVAANAVSKQDYDNAVAAQGQAAADVAAGKASVETAQINLGYTDVVSPITGRVGISQVTPGAYVQASQATLMSTVQQLDPVYVDLTQSSLEGLKLRQDVQSGRLKTTGPGAAKVSLILEDGRTYSQPGKLQFSDVTVDQTTGSVTIRAVFPNPGKVLLPGMFVRARIEEGVNDNAYLVPQIGVTHDQKGQAVAMVVNANNKVEPRTLTATRIEGQNWVVESGLQPGDRVIVQGVDKVRPGATVKAVPAQLASAPNDASGAAAPAAAAPASAAAASAAAASSAGASGAPASAAAGSSAAASGAQ

SEQ ID NO: 212 - DNA, 2205 bp, Burkholderia multivorans
tcaccagttatatttcgcggtggcgatcaccgtgcggtcgttgccgaacatgcagaccgaggtcgactggcaaccgctgatgtaatgacggttgaacaggttcgtcgcgttcaccgcgaagcgccagttgcgcacgtcgtaatgcacggccgcgtcgatcagcgtgtagctcgacaccgtcagcgagttgtcggccgcgccggcggacgcgctctggtagcgcacgccgccgccgagcccgaagcccgcgagcggccccgtgtgccacgtccagtcggcccacagcgacgccatctggcgcggccgcggaatgtcgaccggccagttgttcagcgtcgcgtcgttggcctgcacgaccttcacgtcctgatacgcgtacgacgcgatcagcgacaggttcggcgtgaccttgccggttgcgctcagctcgatcccgcgcgcgcgcacttcaccggtctgcacggatttcgtgccgcccggatcctgcgtcggcagcgccggcgtaacgccgttggtctggttgatctgatagatcgcggcattcagcatcaggttcttgccgggcggctgccagcgcaggcccgcttcgatctgcctgccgcgcgtcggcttcggcaccccgccgtcgagcaggctcacgccgatgatcggattgaacgacgtcgaatagctgatgtacggcgacagcccgtagccggcctgatacgtgaggccgacgcggcccgtaaacgccgacacgtcggccttcgactgcgtcccggccgcgcggtcgtccatccgcatgttgacccagtcctcgcggccgccgagcgtcagcgtccagcggttccacttgatctggtcctgcgcgtacaggccgaacgtgttcatcgtcgtgtacgtgttggtgcggtacgtggtgtccggatcggaaaacacggccgtcgtgaccggcgtgtacaccgggttgtagaggttcagcgtcggcgcggcggcgagccattcgctatcggtcgccgtctggcggttgtactggaagccgagcagcagtgtgtgctggagcggacccgtcgcaaaacggccctcgaggttgttgtcgatgtcgaagcggctgtagttcatctggaacacgccggcccagcggttgatttcggtcagcgtttcgtcggcgaagcccgctccccacaccgagccgttgtcgaccgacagatgcatccatcgcgtgttctgccggaacgtccacatcgagttcaggttgtgctcgaactgatagccgagcgaccactgcttcttgcggtagtagttgaagttgccgtcgccttcgtagatgtccttcgtgatctgcccgttcggattcggcagcaccgtgccggccgcgggcaggaagttcgacgagatgtcgccccagtcctgcagatacgtggccgacagcgtcagcgacgtgtcggcgttcgggcgccagcggaacgacggtgcgagcgcgacgcgctgatcgttgttcgggccggtcaccgcgttgccgtcgcgcgcgacgccgacgaaccggtacgcgtacttgccgtccggatcgagcttgtcgccgacgtcgatcatgaactgcttgcgtgcgtagttgccgatttcgacgcccgcttcgcgcacgcgctcgccgtcggcgagcttcgtcttcacgtcgacgatcgcacccggatcgcccgcgccgtacagcaccgacgtcgggccgcgcagcacggtgatgctgtcgatcatgtacggatcgacgcgccagctcgacaggttcagcgtgttgggcacctgcaggccgttcacgtacgcggtcggcgtgaagccgcgcagcgccgcgtaccagtcggagcggttgtccgagccgtacgacgaaaagcccggcacgtagcgcagcgcggtgttcacgtcggttgcgcccgtcatctcgatctgctgcgcggtcacgacgttgatcgtctgcgggatctcctcgatcggcgtgtcggtcttcgtgccggtccggctgcgcttcgcgacgagccccaccgtgccgtcgccttccgacgccgcgttcacggtgatcgccggcagcgtgccggccgacgcagcgttcggtgcagcggcctgcgcattcgccgccggcgtggtctgcgcgaacgcctgtccggcagccgccgcaccgaatgccacgctcgccgcggccgcgatcgcacgcaaccgcgtgcctgttgcccaatccat

SEQ ID NO: 213 - DNA, 1554 bp, Burkholderia multivorans
atgcttgaggacaacaagatggacaacatgcacaacacaaacggcctgatgcgcatcgcgaaggtggcggccgcgagcacgctgctcgcgacgctgctcgccgcgtgcgcggtgggccccgactacaagcgcccggacgtcacgacgcccgcggcgttcaaggaagcgccgacgctcgcacccggcgagcaggccggtacttggaagccggccgagccggccgacggcgcgcatcgcggcgaatggtggaaggtgttcggggatcccgtgctcgacgcgctcgaggaacaggcgctcgccgcgaaccagaacctgaaggccgcggccgcacgcgtcgaggaggcgcgcgccgcgacgcgcactgcgcgctcgcagtggttcccgcaggtcggcgtcggcttcgggccgacgcgcgaagggctctcgtcggcgtcgcagttccagccgcagggcacagggccgaccaatgcgacgctgtggcgcgcgcagggcaccgtgtcatacgaggccgacctgttcggccgcgtgagccgcaacgtcgaagcgtcgcgcgccgatcaggcgcagagcgaagcgctgttccgttcggtgcagctcgcgctgcaggccgacgtcgcgcagaactacttcgaactgcgccagctcgattcggatcaggacctgtaccgccgcacggtggagctgcgcgaggaagcgctgaagctcgtgcagcgccggttcaacgaaggcgacatcagcgagctcgacgtgtcgcgtgcgaagaacgagcttgcgtccgcgcaggccgatgcggtcggcgtcgcgcgccggcgcgcggcgtccgaacatgcgctcgcgattctgctcggtaaggcgccggccgatttcgcgttcaaggaaacgccgctcgtgccggtcgcggtgaagattccgccgggattgccgtccgcgctgctcgaacgccgtccggacgtcgcggcggccgagcgtgcgatggcagctgcgaacgcacggatcgggctcgcgaagtccgcgtatttcccgaagctcgacatcaccggatcgttcggctatgaagcgtcgacgctcggcaacctgttcctgtggtcgagccgcacgttcctgctcggaccgttcgcgggcaccgcgttgacgctgccgctgttcgacggcggacgccgcgcagccggcgtgcagcaggcgcgcgcgcagtacgacgaacaggtcgcgaactatcggcagcaggtgctcgtcgcgttccgcgaggtcgaggacaatctcgccgatctgcggctgctcgacgatcagattcgcgcgcagaatgcggccgtcaatgcgtcgcgccgtgcggcgacgctgtcgcggacgcagtatcaggaaggcgaagtcgcgtatctcgacgtgatcgatagtgagcggtccgtgttgcagtcgcagttgcaggcgaatcagctcacgggtgcgcaggccgtgtcgaccgtcaacctcatccgtgcacttggtggcgggtggggtgaggcgccgacggcggtcgacggggcggcggcggccaaggcggagatcgcggggcgttga

SEQ ID NO: 214 - DNA, 2247 bp, Burkholderia multivorans
tcagtagcgcgcgttcagcgtgacgaacgcggagcggcccggcgcgatcgacgcgtagtgcgccggatacgcctgatcgaagtacgtgcggttgaacaggttgttcacgttcagctgcaggtcgagcttcttgttgatgcggtactgcgccatcgcatcgaagcgccagtacgacggcaccgcgcgcaggttcgccggatcgccgaacacttccgacatgtagaacgcgccgccgccgaccgtgaacttcggcgtgacgtcgtagttcgtccacatcgtgaagctgtgcttcggcgtattcgggaagcgatggccgttgttcgcggtgtccttgccgttgtcgcgcagttcgctcttcatgtacgtgtagccgccgaacacctgccactgtttcgtgagctggcccgcgacgccgagctcgaggccctgcacgcgcttgttgccgaccatcgcgtactgattgttcggcagcgtcacgcgcgcgttcgtcgtatcgatctggaacagcgcggccgtcagcgacagcttgtcgttcagcacgttccatttcgtgccgacctcgatgctgcggttcttctcgggcgacagctggtcggcgttcgagccgacgccgccgcggcccggcgtcagcgactgcgtctcgctgccttcgccgagcagcatcccggccggcgtcgacgacgtcgcgtacgacgcatagatgctgccgttctgcgcgggcttgaacaccgcgccgagctgccagttgaacagcgtgtcgtcgcgcgtgtaggtcttgccgccgttcgccttggtatcggtgaagcgcgtcgagtaatcgtcgacgcgcacgccggcattgagctgccagcgcggcgtcagctcgatcgtgtcgaagccgtagatcgacttcgtcgtcgtgcgcgcatgcgcatagtcgttgttgcgcgagatcgaaccggcccacggatcggccgggttcggcgaccacaggctcgtgcagttgtagccggacggcgcgccgatgccgttgttgcagatcgcgccggtgccggtcgcgaccgtgtacgtgtcgcgcttgccccattcgcgcgacagctcgatgccggtcgtgaagctgtgcttgaacggaccggtgcggaattcgccgaacagctcggtctggttcgcgatgctgttgatcgaactgttgcggttgttgttgcggcgccagaccttgccgttgatcacgttgccctgactgtcgtcgggctgcgtccagatgtagtcctgcgtcgattcggtgtagcgcgtcgtgttgcgcacggtcagcgccggcgtgatgtcgtgctcgatgcgcagcgtgctgatgtccgacgtcgtcttgcggaagtcgcggtcgatcaggccgtagaagttgtggcggtcgacgggcgccggatagatcgtgtcgacgttcgcgggcttgttcgtcgtcgtgtagaagtacggaatgccgccgtcgggcaggtcgtccgtcgacagatggtagtagctcgcggtcacgcgtgtcggcgtgccgaggccgaacgcgatcgacggcgcgacgccccagcgttcgttgttcacggcgtcgcggcccgccacgtcgttgttgtggctcatcaggttcagccggaacgccgcatgatcggcgaactgccagttgccgtcggcggtgaagcgacggtagcgatcggtgccgagcccggcgctcgcggcggccgtcgtgccgaggtgcggcgccttcgtgatcaggttgatgctgccgcccgcgccgccgcggccgccgtacgcgccgtccgagcctttcgtgatctcgacgcgttcggtgttgaagatttcgcgcgtggtcgcgccggtgtcgcgcatgccgtcgacgaacatgctgccctgcgtgtcgtagccgcggatgaacgggcggtcgccgagcgggttgccgccttcgccggcgccgaacgtgatgccgggcacggtgcgcagcgcttcggtcagcgtcgaggcgccgctcgtctggatcagctcctgcggaatcacggtgaccgatttcggcgtgtcgacgagcggcgcggtgaatttggccgacgcggaaaaatcggccttgtagctgtgctcagcgcggcccttgatctcgatcggcgcgagatggccttccgcgtctgccggcgcgggcggcggggcgccgtcggcggcgaatgcgggaccggcggcgagcacgctgcacagggtggtgaattttccgagcttcgactcgtcggaacgggacttcat

SEQ ID NO: 215 - DNA, 2268 bp, Burkholderia multivorans
tcagaaatcgaccttcatgctgactgcgacggtacggccgggcgacgtataggcgtcgagcaccggcgagtcggcggcgatgccgcgcacgtcggaccagttccagtacttgcggtcgaacaggttgcggatgccgaccgtcgcgctcacgtgcttgttgaagcgatagccgccgcgcagatcgacgacaaacgacgaaggcggcgcgaagcaggctcgcttcgaacagtcggaccggtcgatgtccttgtcgcgcttcgcggcctggaacagcagatcggtctgcacgaaccagcgttcggtcggctcgtagcgcacgccgaacacggcagaaaacggattcacggtgttgagcggctggctcgcggcgccgtcgttttgcgtcgagccgcgcgtcagcgcgagcgcggtgcgcagcgtgatgccgttcggcatcgcccagtcggcgcggccttcgatgccgtgaacgcgcgcatcggcgaagttcacgtactggaacacgaacggatcggtcggccggccgctgccggcgatcgtcgtacgcgcgatgaagttgcggtagcggccggtgaacgcggccgcgctgtagcgaatcgtgccgtagccggtgccggcccgcccgcgcagcccggcttcgaacgtgtcgctggtctcgggcttcaggttcggattgccgatcgaggtatagccctgcacgggattcgagaagctgctgttgacctgatcgggcgtcggcgcgcggaatccatgtgcgtactgcagatacggaatcagcgcaggcgcgatctcgtacagcaccgcgacgcgcggcgacagttcgttcgcgtgcgtcgacaccgcgcggccggtgaacagcggatcgttgcccgacggcttcagccggtacgtgtcgaagcgcagccccggcgtgacgagcaggcggccgtagccgatctgatcctgcacgaacgcgccgaacagcgtgtagtcggtgtcggggaaggccttgttcgggaacgtctcgccgacgccgggcaccgtgccgtcgcgcaggttcgtgatccgcgacaggctgccgtcgacgccgcccagcagcttgtgcgcaagcgggccggtcgagaatccgctttcggcgaacgcggagccgccgaacgtgcgttcgcggtagcggttgtcgcgcgagcgtgacggcagcgtgccgcgcgtttcgaacgcgtactggtcctgcgtcgcttcctggtaatagaactgcacgtgcgcgttctgcagccagcgcgaggcgtcgtcgtgaaaggcgtaatcggcgctgaagcggttgcgttcgagccggtcgctcgtcgtgaggccgagcgtcgcgggcgcgacgatcgcagatagcacgtcggtgccgacgcgccgctgcacggtttcggcggtcagcctgatcgtgtcgcgcacggtgggcgtcagcacgagcttgccgagcagcgattcgctgtacacgtgctgcgggttcgacgtcgtgcgcagcttgcctgcggagttgttgctgccgcgcgtgtcgatctcgtgaccgcggcggccgtcggcgatgatcatcccctggatgcgatcgttgccgccggcggccgacacggtcgcgccgatgctgcggtcggtcgaatcgtagctcggccggaacgagaagtaggtcggcttgtggtagatcgacagcaggtcctgcggatccttcgtgatgaagttgacggcaccggtcagtccgtcgctgccgtacagcgccgacgccggcccgcgcacgatctcgatgcgcttcagcgtatcgagatcggtgtagtcgccgcggcccgcctcgagcgggccgaacgagaatgcgttcggcaggcggatgccgtcttccatcagcatcacgcgattgccttcgaggccgcggatgttgatgctcgaatcgccgtcgcggccgccgccgagcgccgcgttgccgggacggtacgcggtgcgccgcaccgtgatgccgggctcgtagcgcaaggcgtccttgatgttggtggcctgctgttcgtcgaggtcgtccgcgtcgatcaccgacacggaagcggcggtgcggctcgcggccgtcgcggtgcgcgtcgccgtgacggtgaccgggtcgagcagcgcgctgctggcgcgtgcggctgccgcgtcggccgtgacggacgaggcggcggtgtgggacggcgaagaatcggcgtgagccgtggcggcggacaatccgaccgcgccgatgagcgcggcaaagatcggctggcgcgccagcgtagagcgatgcac

SEQ ID NO: 216 - DNA, 2142 bp, Burkholderia multivorans
ctacagcttcgcgctgacgcgcacccaggcggtgcggcccggctcgttgaccggcgcgttcgccggatagccgaagcccgcattgccggcgaggttcagatgctcggcataggccttgttcagcaggttgtcgacgccgaccgagatctgcacggtcttgctcacgttgtactgcgcatgcagcgacagcacgccgaagcccgcgctcgggccgaagtccttgccgaccacgttgccctcgttcaccgcatagcgatgctgcggcgcaacgacccgccacaaaccgccggccgaccacgcgccgcgcgtgtactcgagcccgacgcgcgcctcgagcggcggcatctgcggcaacggatcgccgctcgtcgcattgcgcccccacgcgtacgcaaccgaggtctcgatacgcagcggtgcgaccggccgccagccgacgccggcttcgccgcccatgatctgcgcgttcacgttgctcgcccgcgtggtcgggcccatcatgccgctcgcgtagtcgaacaggatgaagtcctgcacatagcctgcatacgcggagacccacgcgtcgagccgatcgctcttgtactgcgcgccgatgtcgagctgcgtcgtcttctcgggctgcacggccgagaaagcgttgaccgaaccggccggcccgcgtttcgcggaaaacagctcccagtagtccggatagcgctccgcatggccgatgcccgcataccaggtcacgggcagcgacgccaggtcgcgctcgtagcgcaggaagccgctcggcagcacgcgcgcgcgatcgtcgtcgaacgtcgggttcggccggctcgtcatcatgccgcccgtcgtcgcgcgcttgtcacgcgcgctcgcatagtcgacgcgcgcgccgccgatcacgcgcgccgcctccgccgcgtaccacgtgagctcgccgaacgcgccggcgttccacatcgtcgcctgcgcgtcccacggctggtcgccatagttctgccgccccatcgcggcgcgcgaatcgagccggttcgattgcgcgtcgacgcccgtcacgagcttgaacgcgtcgccgaatcgccacgtcgcggccgcacgcgcgccgagcgttcgacgccgcacctcggacgccatccgcatcggcatgctgctcgccggatcgggctgccgcagcgtgtagttgtccatcacgtgatcggcttcgttgtagtagacgcgcgcttcgatccggtcgagcacgtcgccgagatgccgcttgtcgaacgacaggccgaacgtgtcgcggcggaagtgcgcgccgtccatcccgcgccccgcatagcgcgcgtagccatcgccggtgccggccgtcagctcgacgcgcgtgtgcacgtcgggcgtccagccgagcgcggcatcggcgttccatttgtcccattgcgacggcaccgtgcggccgttgccgtcgcggtagtcctgcgcatgcgcgtgattcgcgatgacgcggccgtagaaatcgggcgtgccggccgtcacgtcgacgttctggtcgttgcggccgaacgacccgccgacgacgctgccgtcgaagcgcatgccgggccgctcgaaacgcggcgtcgtgcgctcgaacagcacggtgccggccgatgcgccggggccgtacagcaccgtctgcggccctttcacgaccgtcaccttgtcgtagctttccggtgcgatataggaagtcggcgcgtccatccggttcggacacgcgccgagcgtcggcatcccgttcgcgagcacgttgagccgcgagccgaacatgccgcgcagtacggggtcgccgttcgttccgccgctgcggatcgacgtgaagccggggatcgtcttcagatagtcggcgccgtcgctcgcgggcagcggctggcgcggcgccttcggatcggtgacgacgacgagcggcgtcgacaacggcgacgcgacgacttcgacgggcagcaacagcatgcccggcgtgtcgggcggtacatcggcgcgatgtgcgggggcgtcggcgtcggccgcggcggccgtcgcgctcagcacgccggcggtcagcgcgggaacggcaagtttcagcatgcgcggcgcgggccgcgcgcaggcactgggcgacgccggcggcgtgcgcaacgaaaaaatggtcat

SEQ ID NO: 217 - DNA, 2592 bp, Burkholderia multivorans
tcagaactgcagcgtggtcagcagcgacacctgccgcgcgtcgccgatcgcgacgaagtagcggttcgcgctcgacgggtagtacgtgcggttgaacaggttcttcacgttcagctggaacgacagcttctgcttgccgagccgcgtgtcgtaggttgcgaacgcgtcggcgagcacgtacgacggcagcgtgaagctgttcgccgaatcgccgggccgtgcgccgacatagcgtgcagccgcaccgatgcgcagatcgtcgccgcccgcgagcgtgcccacgtcgtacacggccgcgagcgacgcggtgtgacgcgcgacgttccacagccggttgccggcgtacagcggatcctcgatcgtcttcgcgtcgatgtacgcgtagctcgcgatcacgttcacgcgttcgccgatgcggcccgacacgtcgagctcgacgccgcgcgagcgcgccttgcccgacgtgcgccagtcggtcagcttcgtcgcgtcgttgaactgcgagacgagcacgttcttcttgtcgatgtcgaacagcgcgagcgtgcccgtgatgccgcccggcaggtcgagcttgccgccgacctcccacgcggtcgcctgctccggcggcgtcgcggcgtcgatcacgtagccggacgccatcggcgcgatcgacgacgacggcttcagcgactgcgaatagctgccgtacagcgagaagctatcggtccacttgtagacgatgcccgcgcgcggcagccagcgcgagccgctcagatcggtgttcgcatgaaacggccggccgcgccccgcgacctggttgtacgtgatatagcgcacgccgcccgagacgatccacttgtcggtcagatgaatcgtgtcctgcagaaacgcggacgcgtcgtgcagcgcgtcggtctggtcgctgtcgctcgccgacaccgtgctcgacggcggcagcagcccgtacacgggatcgacgtagctgaacggcgtcttcaccgcctgccgcagcatgtccttgcgatagatgcggcggtactcggtgtcgaagccgacctgcacgtcgtgccgcatccccgcgagcgtcagcttgccgttcacgtagccgatcccgtagctgtcggtgctcagcgagccgtgcgtcgcgtcgttgctgcgcgacagcgtacccgtcaccggatcgacgcccgtcgtgcgcagctggttcgcatcgtaggtttcgcggttgtagctgtagccgaaatgcgcgctccagtccgcgttgaactggtgatcgacgctcagctgggcgagatgcgattcgccgtccatgttgttgaacggctcgtcgatgcgccgccgcgcgggaatgtcgagcggcgcgttggtgcgcggatcgagcgccgtgccgcgatcgaacggcgagtggaacttgcggtactcgtacgacaccacgacctgcgtgtcgcggccgtaccacgcgagcgacggcgcgacgaaggtctgccggtattcgccgaaattgcgccagtactgctcgttcgactggtcgacgatcagccggtacgcgagccgcgaatcgccgatcggcccggtcgaatcgaacgtcgcgctgccgccgttcttgccgtgcccgaacgtcgatgcgccgagcgaaaccgcgttgtagcgcgtgagctgcggctgcttgctgacgacgttgacgacgccgcccgggtccatcagcccgtacagcagcgaggtcggccccttcagcacctcgacgctgtcgacggcggcgttgaacgagcgcccctgcacgatcggcatgccgttgtgcatgaccgagccgtcgcggttgtcgccgaagccgcgcttcatgatcgtgtcctgcgtgcccgcgagcgtgttgccctgcgtgatgccgctgacgttgccgagcgcgtcgtcgaggttgcgcggacgctggtcgcgcagcacctgcgccggcacgacgttgacggcctgcgcggtatcgagcaccgggatatcggcgcgcagcacgcccgcctccttcggcggccggtagctttgcgcgcgcagcgcgctgctgcgcaccgcgatcgtcggcagttcggccgccgtatcggccgacggcgccggcacggcggcaccgctcatgccgttcgcgccgttcgcgccgttcgcgcgcatcaacgtatagccgccgcccgactgacgcagcgcgacgaggccagtgcccgcgagcacgcgcgcgagcgcatcgtcgacgtcgaagcggccgtgcacgccgccgctcgacaggccggcggtcagctcaggcggaaacgcgatcagcaggccggcgtcgcggccgaaccggttcagcgtcgcttcgagcggcccggccggcacgtcgaatgcgcggcgcgacgtgcgcggcgcggcggcggccgcgtcggtgtcggcatcggcgagcgcgggcaacggcagcagcgcggacagcaggacggcgccggcaagccggtgcgcgacgcggttcggcgcggcgggcacgatcgtgcgccgcgtgtggcgggcggacgccggacggcgccgcggcatgagacggatggaaaccatgatcgagaagtcggtaaacgatgggccggtgcggctttcatttcccat

SEQ ID NO: 218 - DNA, 645 bp, Burkholderia multivorans
ttactggtgctgcggcgcgcgcagatagatctcgacgcggcggttctgtgcgcggccggcttcggtcgagttgtccgcgaccgggttcgacgggcccatgccctgcgccgacaggcggttgcccgcgacgccgcgctgcaccagcgcgttgacgacgctttgcgcgcggttctgcgacagcgtctggttcagctgcgcggagcccgtgctgtcggtgtagccgatcaccgacgccgtcacttgcgggttctggttcagcgtcgttgccaggtcgttcagcagcggcgtgaaggccggcgtgatcgcgtactggttcgtcgcgaacgtgaccgagctcggcacgttcagcttcagcgagccgtccggctgctcggtgacctgcgtgcccgtctgcgcagccgacggcgcgagcttgttcttgatcgcttgccagttgtagcccgtcacgccgccgaccagcgcgccgacgcccgcgccgatcgccgcgcccttgccgccgcctgccagtgcgccgatgcctgcgcccagcgccgcacccgtgccggtgccgacggccgtgttgttgccttgctgcgtcgcgcagcctgccagcagggcgccggccagtgcgaagacggacaagcgggtcgcgattttcatgttcat

SEQ ID NO: 219 - DNA, 531 bp, Burkholderia multivorans
atgaccacaaggagagtaaccatgatgtcgaaaaaagttcgtctggccctggccgtgatgatgatcggcgcgctcgcagcgtgtaagtcgggtgtgaagctcgacgacaaggcaaacgccggtgcgatgagcacgcaaccgagcgccgacaacgtcgcgcaagtgaacgtcgatccgctgaacgatccgaacagcccgctcgcgaagcgcagcatctacttcgacttcgacagctattcggtgaaggacgagtatcagccgctgctgcaacagcacgctcagtatctgaagagccacccgcagcgccacgtgctgatccagggcaataccgacgaacgcggcacgagcgagtacaacctcgcgctgggccagaagcgtgcggaagccgtgcgccgcgcgctcgcgctgctcggcgttgccgattcgcagatggaagccgtgagcctcggcaaggaaaagccgcaagcaacgggtcacgacgaagcgtcgtgggcgcagaaccgccgcgccgatctcgtctaccaacagtaa

SEQ ID NO: 220 - DNA, 669 bp, Burkholderia multivorans
atgaataaactttcaaagctcgcgttcattgcagctaccgcagttatggctgcatccgcttcggcacagtcggtgccggcgtcgcgtcaagccgtcaatgacaactgggtgaacggcacgggcgaatgggtgtggatgaacggcacgaacgagctctgctggcgtgacgcgttctggacgccggccaccgccaacgcgaagtgcgacggcgcactggtcgcccaggcaccgcagccgccggtcgctccggtcgctccggccatcacgagccagaagatcacgtatcaagccgacgcactgttcgacttcgacaaggcgacgctcaagccgctgggcaagcagaagctcgacgaactggcttcgaagatccagggcatgaacacggaagtggtcgtcgcaacgggctacaccgaccgcatcggttcggacaagtacaacgaccgtctgtcgctgcgccgtgcgcaagccgtcaagtcgtacctggtcagcaagggtgtcccggccaacaagatctacacggaaggcaagggcaagcgcaacccggtcacgacgggctgcaaccagaagaaccgcaagcaactgatcgcctgcctcgcaccggatcgccgcgtggaagtggaagtggtcggtacgcaagaagtgcagaagacgaccgttccggcgcagtaa

SEQ ID NO: 221 - DNA, 1140 bp, Burkholderia multivorans
atgaaaaagaccctgatcttcgccgccctgtccggcgcgtgcgcggccgcgcacgcgcaaagcagcgtcacgctctacgggctgatcgacgccggcatcacgtatacgaacaaccagggcggccacagcgcgtggcaggagacgagcggctcgatcaacggcagccgctgggggctgcgcggtaccgaggacctcggcggcggactgaaggcgatcttcacgctcgagaacggcttcgggatcaacaacggcacgctgaagcagaacggccgcgagttcggccgccaggcattcgtcggcctcgcgcacagcgggttcggctcgctgacgctcggtcgccagtacgacagcgtcgtcgacttcctcggcccgctgtcgctgacggggacgcaatacggcggcacgcagttcgcgcatccgttcgacaacgacaacctgaacaactcgttccggatcagcaatgcggtcaagtatcaaagcgcagacttcggtggactgaagttcggcgcactctacggcttctcgaattcgaccgatttctcgaacaaccgcgcgtacagcgtcggcgcgtcgtacagcttcatgggcttcaacgtcgcggccgcctacatgcaactgaacaacaacatcaattcgctcgcgctcgcggccagcgatccgggcgcagtggccggcgactggacgttcgcggcaagccggcagcgcacttggggcgccggcctcaactacgcgttcggcccggcaaccgcgggcttcgtgttcacgcagacgcgcctcaccgattcggccggcatcagcgccggccaatcgggcgtgtcgggcggcatcccgctgacgggcgacacgcgcttcaacaactacgaattgaacgcgcgctatgcactgacgccggcgttctcgctcgcgggctcgtacacgtacaccgacggccgcatggaaggacagaagccgagttggcaccagttcaacctgcaggccgactacgcgctgtcgaagcgcaccgatctgtatctgcagggcgaataccagcgcgtgaacggggacggtctcgcggtcggcgcgaacatcaacggcctcggcgtcgcgtcgtcgaccaacaagcagatcgcggtgacggccggcatgcgtcaccgcttctga

SEQ ID NO: 222 - DNA, 1155 bp, Burkholderia multivorans
atgaggaagcacgtcatttttgccgccgcgctcgccgcgtttgccgcgccggccttcgcgcaggacagcgtgacgctgtacggtgtgatcgacgagggcttcaactacacgaacaacgtgagcgtcaacggcgcgggcaaggccgattaccagctcgcgagcggctatgcgcagggcagccgctgggggctcaaggggagcgaggatctcggcggcgggctgaaggcgatcttcacgctcgaaagcggtttcgacgtgaacaacggccggctcgggcagggcagccggatgttcggccggcaggcgttcgtcggcctcggcacgtcgcgtttcggcacgctgacgttcggccgccagtacgattcggtcgtcgactatctcgcgccgctgaccgcgaacggcaactggggcggcacgctgttctcgcatccgttcgacaacgacaacaccgacaactcgtttcgcgtgaacaacacggtgaagtacgcgagcccggactggaacgggctgtcggtcggcggcacgtacagcttcagcaacagcaccggcttctcgaacaaccgtcagtacagcctcggcgcgcagtattcgctcgccggcctgcaggtcgcggccgcgtacctgcaggccaaccatccgggcgccggcggcgcgggtgcgatcgccgcggacgacgcgaacttcgtcgccgagcggctgcgggttttcggcggcgggctgaactacacgttcgggcccgcgacggtcggcttcgtctacacgaagaccgacttgaagaacccggtgtcgaccgtctatctgccggcgtcgacgttcgcgggcctcgggctcggcgcgacgaaattcgacaacttcgaggtcaacggcaagtatcagctgacgtccgcgttctacgtcggcgcgcagtacgtgtatacggacggcaagttcgatgcggcgaccggatcgatcaagccgaagtaccacacggtcgggctgatggccgactacagcctgtcgaagcgcaccgacgtctacctgcagggcgcgtggcaaaaggtggccggcgatcgcacgggtaccgcggccgacggcggctacgtggtcgggaccgacggcccgtcgtcgtcgtcgaaccagttcgcggtgcgcgccgcgattcgtcacaagttctga

SEQ ID NO: 223 - DNA, 1092 bp, Burkholderia multivorans
atgaacaagactctgatcgttgcagcagctgcagcatcgttcgcaaccgtcgctcacgcgcaaagcagcgtcacgctgtacggcgtgctggacgcaggcatcacgtaccaaagcaacgttcagccggccccgggccaggctggcaagtcgctgtggtcgatgggctcgggcattgaccagagccgcttcggcctgcgtggttcggaagacctcggtggtggcctgaaggcgatcttcacgttggagagcggcttcgacatcggcaacggccgtttccgtaacaacggcggcatgttcaaccgtcaggctttcgtcggtctgtcgagccagtacggcaccgtcacgctgggcaagcagtatgactccgttcaagactacctggctccgctgaccgcaacgggcagctggggtggtacgtacttcgcgcacgtcggcaacttcgacaacctgagcacgaacggtggctactcgccgaacaacagcatcaagttcacgagcgctaactacgctggcctgcaattcggcggcacgtactcgttctcgaacaacacgaacttcggcaacaaccgtgcttacagcggcggcgtgtcgtaccagttccaaggcctgaagatcgcaggtgcgtactcgcaactgaacaacccgggccaaacgaccggcggcgcagttgacacgctgcaaacgcaaggccgcgtccgtacgtacggcgcagctgctggctacgcattcggcccggcacaagtcggcgcagcatggacgcaagctcgtctggacaacacgggcgcgaccggtacgtcggttcgcatcgacaactacgaagtcaacggcaagtacaacctgacgccggctctgggtctgggcgttgcttacacgtactcgaacgcgcgtctgggtcaggacagcgctcactggcaccaagttggcctgcaggctgactacgcactgtcgaagcgtaccgacgtgtacgcacaggctgtgtaccagcgtgctagcggcgcgaacgcgtcgatctacaacggcaacatcgacacgctgccgagctcgtcgatcaaccaaaccgcagcaacggttggtctgcgtcaccgcttctaa

SEQ ID NO: 224 - DNA, 1161 bp, Burkholderia multivorans
atgaagaaacttgctctctcggccctctcgctcgccctgctgggcgccgccggcgctgcacaggctcaatccagcgtgacgctgtacggcgtgatcgatacgtcgattgcctatgttcatggcaatgacggccaagccaacaacatgtggcaaatgctgtcgggcaacctgcaaggcagccgctggggcctgaagggtgctgaagacctgggcggcggcctgaaggcaatcttccagatcgaaaacggcttcaacccgggcacgggcaagctgagcgcagcaaacacgatcttcaaccgccaggcattcgtcggtctgcaaagcaaccagtacggtacgctgacgctcggccgccagtacgacccggtcgtcgaccttgtccaggcagtcacggctgacaactacttcggcagcttcttcgcgaccccgggtgacgtcgacaacaacgacaacagcctgcgcgtcagcaacgcgatcaagtacacgtcgcccgtctacgccggcttccagttcgaaggcatgtacggcctgagcggcatcgcaggcaagccgggccagggtcagacgtggtcggctgctgcggcctacaacaacggcccgatcggcatcgcagccggctacttctacgcgaacaacccgtcgccgacgaccaccgcggtccgtggcggctggggctcgacgacgtcggacaacatcgtcgacggcccgatcaacgccggctatgtgacggcgaagtcgatcggcatcgcgcaagtcgcagctcagtacgcgatcggcccggtgacgttcggcctcggctacagcaacgcgcaatacaagccggacgcttactcgacgttctcgtcgaccgagaagtacaacacgggccgcggcttcgtgacgtaccaggtcacggcgccgctgctgctgggcctcggctactcgtacacgaaggcaagcggcaacacggacgcgaagtaccaccaggtttcgctgggcgcagactactcgctgtcgaagcgcacggacgtctacctggtcggcgcgtaccaacacgccagcggcacgcagctcaacacggacggcacgacgtcggcagcgcaagcgtcgatcggctcgtatggctatgccggcacgaagtcgcaggagatggttgccctcggcctgcgccacaagttctaa

SEQ ID NO: 225 - DNA, 1464 bp, Burkholderia multivorans
tcacgcgtcgtcggcggccgtgccgggcgtccagccaccgccgagcgcgcgatacagcgcgatcgcgttcgcgagccgcagctgcctgagccggatcagctcctgtcccgattcgtacgtgctgcgctgcgcgtcgagcagttcgagatacgtcgcgacgccgcccgcgtaacgacgttccgcgagcttcagccgcgcgtcgtcggccgcgtgcacgtcgcgctgcgcggccagctggcgctcgatccagtcgcgtgccgtaaaggcgtccgcgacctcgcggaacgcgacctgcacggtcttctcatactcggcgaccgcaatgtgccgccgcgcgttcgcgacgtcgagattcgcgcgattgcgcccgcccgcaaaaatcggcagcgtgatgcgcggcgcgaaggtccagacgctcgtgccggccgcgaacaggctcgaaaacgcgtcgctgaccgagccgtaatcggtcgtcagcgcgatgcgcgggaaaaacgcggcgcgcgcggcgccgatctgcgcgtgcgcggccttgagccgcgactcggcctgccggatgtccggacgtcgctcgagcagatcgctcggcgcaccgggcgcgaccggcgcgatcgtcagcgcgtcgagcgccgtatcgtcgtcgcgcacgtcgcgcgcgaaatcgccggcaagcagttgcagcgcgcgcacggcctgcgcgtgctcgcgctgcagcgccgcgtgcgatgcacgcgcggccgcgaccagcatctcggccgaacgcagttcgatcgcatcgctcgtgccggccgcatagcggcgttgcgtcagcgcggcgatccgttcgcgcgcatcgagcgtgcgctcggcgagcgcgcgctgttcgttcagcgcgcgttccgcgacgtaggcattcgcgacttcggcgatcacgccgatacggaccgtgcgctgcgcgtcggccgtcgcgaaatactcggccagcgctgcatcggacagattgcgcacgcgcccgaacagatcgagttcgtatgcgctgatgccgacgcccgcccgatacagcccgctcaccgcgctctcgcgcaggaccggatcgtattgccgcgtgcgttcgtaaccggtgctcgcgtcgatcgacggcatccgctccgcacgctgcacgccgtacatcgcgcgcgcctcgtcgagccggccggccgcgatccgcagatcgcgattgttggcgagcgccgcgtcgatccatgcatgcagcgcgggcgcggtgaaatagctgcgccagtcgtcgagcagcgccgcatcggcgcgcggcgcgaaagccgacggcgcgtcgtgcgtggcgtcgacgccgttcgtatacgcggacggcaccggcgcagccggacgctcgtagcgcggcgcgagcgaacagccggccagcacgagcgcggccgccagcgcgaacggcgcgcgccgcgcggtgcggcgcgaatcggaacgatgcctcat

SEQ ID NO: 226 - DNA, 1524 bp, Burkholderia multivorans
atgatgcaaaaacacgctttgactgcaatcgcggtcgcgctccttgccgcaggctgcacgttggcgccgcactacacgcggcccgacgcgcccgtcgcgcaggcgtttccgtccggcggcgtctatgcgacgcagccgggcgctgccggcgcgcgcagcgcgaacggccaggcggcgaccgccatcggctggcgcgaattcttcgtcgatccgcgcctgcagcggctgatcgagatcgcgctgaagaacaaccgcgacctgcgcgtgtcggtgctgaacatcgaggcggcgcgcgcgcagtatcagatcacgcgcgcgggcctgttcccgacgctcgacggcacgggcaccggcaatatccagcgcgtgccgcagggcgtgtcgcagacgggtgcgccgtatatctcgcgcgtctacaacgtcggcttgtcggcgtcgtgggagctcgatctgttcggccgcgtgcagagcctgaaggaccaggcgctcgcgcagtatctgtcgaccgcgtatgcgcggcaggctgccgagatctcgctcgtgtcgcaggtcgcggatcagtatctgacgctgctgtcgaccgacgatctgctgaaggtcacggaagacacgctgaagacggctcaggcctcttacgacctgacgaagctgcagttcgacaacggcacgggctccgagctcgagctgcgtcaggcgcagacggtcgtcgagcaggcgctcgcgaaccagcaggcgcaggcgcgcgctcgtgcgcaggcgctcaacgcgctggtgctgctgatcggcgagccgctgccggacgatctgccgccggggctgccgctcgatgcgcaaaatctgctcgccgacgtgccggccgggctgccgtcggatctgctgacgcgccgtcccgacatcatgcaggccgagcagacgctgctcgccgcgaacgcgaacatcggcgcggcgcgcgcggcattcttcccgcgcatctcgctgacgggcgcgttcggcaccgcgagcccgacgctcggcgggctgttcaaggccggcaccgcggcgtggtcgttcgcgccgcagatcacgatgccgatcttcgaaggcgggcagaacatcgcgaacctgaacctcgcgaacgtgcagaagcgcatcgagatcgcgaactacgagaaggcgatccagagcgcgttccgcgaagtggccgacggtctggccgcgcgcggcacgtacgatcagcagatcgccgcgctcgagcgcaacacgcatgcgcagcagcgccgcttcgatctgtcggacctgcgctacaagaacggtgtcgacagctatctgtccgtgctgaccgcgcagaccgatctgtacacggcgcagcaggcgctgatcaacgcgcggctcgcgcgctggacgaacctcgtcgatctgtaccgtgcgctcggcggcggctggatcgagcgggccggcgagacgccgcgggcgcccgatcagacggtcgattacgacaaggcctcggcgcctgcgtcggcgtcggctgcggcgacgaacgggtaa

SEQ ID NO: 227 - DNA, 477 bp, Burkholderia multivorans
ttactccggcgaacccatcatcgactgctgatagttctgcaggccgaccttgccgatcaggtcgatctgcgtttccagccagtcgatatgctcttcggtatcgtcgaggatcttttcgaagatctcgcgcgacacgtagtcgcgcaccgattcgcaataggcgatcgcttccttgcaggtggcctgcgagatctgctcgagcttcaggtcgcacttcaggatttcttcggtctcctcgccgacgagcagcttgtgcagatcctgcaggttcggcaggccgtcgagcatgaacacgcgttcgatcagccagtccgcgtgtttcatttcgccgatcgactcgtcgtattcgtgcttgccgagcttgtcgaggccccagtgcttgtacatgcgggcatgcaggaagtactggttgatcgccgtgagttcgttcttcagctgggcgttcaggtattcgatgactttcttgtcgccttgcat

SEQ ID NO: 228 - DNA, 237 bp, Burkholderia multivorans
tcaggccgccttgcgttcgtagaacgtcaccggaatcggatgagcgtgatgctcgacgccgcaccggctcgcgcacacgccgtgttcggccatcaggtcgcgtaccgactcctcgcatttgccgcagcaggtcgccacgccaagctcgaactgaagctcgtcgaacgagtccacgccctccgcgagggacgcgcgaatcttccgatcggaaacagacttgcatacgcagacgatcat

SEQ ID NO: 229 - DNA, 921 bp, Burkholderia multivorans
tcacttgaaccggatggtcggattgatgaccgcgtagagcacgtcgacggtcaggttgatcaggatgaattcgagcgagaacagcagcacgatcgcctggatcaccgggtaatcgcgcatcgtcaccgaatcgacgagcagccggccgagccccggccagttgaacacggcctcgacgacgatcgacccgccgagcaggaagccgaactgcagccccatcatcgtgacgaccggaatcatcgcgttgcgcaggcagtgtttgagcacgaccttcggctcgtgcacacccttcgcgcgcgcggtgcgcacgaagtcctcgttcatcacctcgacgaacgacgcgcgcgtgaagcgcgccatcacggccgcgaccgccgcgccgagcgtgagcgacggcagcacgtagctcttccacgtgtcgtccggcacgacgggcagccagccgagcttcaccgagaagatctccatcaagagcatgccgagcgcgaacgccggaaacgagatgccggacaccgcgagcgtcatgccgagccggtccggccagcggttgcgccatacggccgacgcgatgccgatcgccatcccgaacagcgtcgcccacgccatgctgacgatcgtcagcatcagcgtcggcatgaagcgctcgccgatttccgtcgataccggccgcttgctgcgcgtcgatacgccgaaatcgccgtgtgcgatcttcacgaagaaattcgcgaactgcgtgggcagcggccgatcgaggccgagatcggcgcgcacgagcgcgaccgtcgcttcgtcggcctcggggccggccgcgagccgcgccgggtcgcccggcagcagatgcacgaacagaaacacgagcaccgcgacgatcgcgagcgtgggcagcaggccgaacagccgtttgatgatgaaagtcagcat

SEQ ID NO: 230 - DNA, 1200 bp, Burkholderia multivorans
tcagaagcggtggatcatgccgacgccgacggcgatctggttctggccggcacctgctgccacgccgtcgccgatttgcgtcgttgccgactggatcgcgccagccttgctcagcgtattgccgctcgcgtgctggtacgcctcgagtgcgtacaggcccgtgcgcttcgacaggctgtagtactgcgacagcgtgacctggtggtacttcgccgagctcgagatgccgttcgacttcgttgccgccgtgtacgagtagcccgccgcgaagtcccactgagccgctgccttccagtgcagcacggcaccggccgtgttgaagatcgcggtgttgcggaacgacgagccgacgcccgggatgtactggacgttcgtgtaggacacggacacgtcccacgccggcgtgaactggtagccggccgtcacgccgaggcgctgctgcgattgcgccgttgcgtagccgttgttgatcgccgacacggccggctggccgccgctcgtgaccgtcgagttgtcgccccacgcgccgccgccgagcgtcgagttgttgacgcgctgatagccgaccgcgatgcctgccgggccgttcaggtactggatcgccgcgctccacgtcgagccgcggttcacgctgcccggcacgccgccgaacgagtacgagccgccgaccgtgaagccgtagaacttcggcgacatgtagacgagcgaattgttcgcgcggtagctcgtatcgagcgagtcgatatcacccgggtgcgcgccgtatgcgcccgtcagccacgtcgtcgggctgtacggcgacagcagcgtgtagtacgccgtgtactggcgaccagccgtcagcgtaccgtacgccgcgttcgtcaggccgacccacgcctgacgcgtgaagatgccgcccgaccactgcgatgcgcccgttgccgtgttcacgccggcttcgagctggaagatcgccttcgtgccgccgccgaggtcttcgttgcccttcaggccgaagcggctgcctgcccacacgccggtggacatcgacaccttcgaatgaccgccgctcgtcgcgccggtcgacggtgccgcgttattctggtacgccagaccgttatcgacgataccgtacagggtcacgctgctctgagcgtgggcggcggtagcggccgcaaggccggctgccgtcatggcgacgacgacgcgctttttcat

SEQ ID NO: 231 - DNA, 1497 bp, Burkholderia multivorans
atgaaatcctccccgttgtccgtgcgtgccgggtcgcgccgcaccgccgttgccgttgcggtcgccgcactggcactggcgggctgcgcgaactacatcggcatcaagagcgacaagcagatcgcccccgcgtcgcagttcgaaaccgcgcagagccttccggcccagggcggccactggccgtcgctcgactgggcgagccagttcggcgatccgcagctgccgaagctgatcgacgaggcgctcgccggcaatccgtcgatcgcgcaggcgcaggcgcgcatcgcgaaggcgtcgtcgtatatcgaatcgtcgcgctcgaacctgctgccgaaggccgaagcgagctactcgtggacgcgcgagctctattcggcgaacggcctcttcccgccgccgtacggcggccagtggtacagcgagaacaacgtgctcgccagcgcatcgtgggagctcgacctgtggggcaagaaccgcgagcgcctgcgcacggccgtgtcgcaggaaaaggccgcggaagccgacatgcagcaggcgcgcatcacgctcgcctcgtcggtcgcgcgcacctacaactcgctcgcgcagctgtacgcgctgcgcgacatcgcgcagcgcgagatcgccaaccgcgagtcggtcggcaagatcaccgacggccgcgtgtcggccggcctcgacacgaacgtcgaacgccagaccgcacgcggcaacatcgcgacgacgcaggcgtcgctgtccgatctcgacggtcagatcacgaccgtgcgctaccagctcgccgcactgctcggcaaagggccggaccgcgggctgcagatcgccgcgccggtgctgaacccggccggcgacgtcgcgctacccgacaacctgcccgccgacctcgtatcgcgccgccccgacatcgtcgccgcgcgctggcaggtcgaagcggcaatgcacgacgtgaaggaagcgaaggccgagttcttcccggacgtgaacctcgcggccggtttcggtttcgatgcgttcggctggggcaaattcctgaacttcacgagccgccaggcgcagttcggcccggcgatccatctgccgatcttcgacgccggcgcgctgcgcgcgcagctcaagggccgctacgcggacttcgatctgtcggtcgcgaactacaaccagacgctgatcagcgcgctgaacgacgtggcgacgcaagttgccgcgatccgtgcgatcgatcgccagatgggcgacgcgcagcgcgcgctcgacgcgtcgacgcgcgcatacgatctcgcggtgattcgctacaaggccggcctgtcgccgcagctgcaggtgctgaccgcggacagcaaccggctcgcctcggagcagaccgtgacgaatctgaagatgcgccgtcgcgacatgcagctcgcgctgatcaaggcgctcggcggcggcttcgatgcgaccggcaccgcgctcgcggcgcccgagaccgcgaaacagacccgacaggccgccaactga

SEQ ID NO: 232 - DNA, 2367 bp, Burkholderia multivorans
tcacagcgaccatttcagttctccatagaaagtgcgacccggatacgggtggaacacgtagtagcggcggtccgtcaggttgtcgatgccaaccgatgcggtccagtgacgatcgaagcgatagcgcgccttcacgtcgacgaccgtaaacgcgctcgtgccgccatagacgtcgggattcacgtcgctgttgtcgagcgtgttgaactgccggcccgaatagcgcacgccgacgctcgcgagccagtgctcgtcgaagcgatacgacgcgagcagattcgcgcgcatccgcggaatgcgcggaaagcgcgagccgacgtacgccgggttggcggcatcggcgagaatctgcgcattgctcgccgatacgttcgcgtcgatcgcgagccccttgagcccgacgttttcgccgctgaacgcgagttcgacgccgcgcacgcgcacgcggtcgacgttcgagatgttggtgaccgtcgaggcgccggcgaccgtcgtctggctgtagatggaatcgcgcaagtcgctctggaacacgctcgcacgcacgacgccgacgccgacgtcgcgctccgcggtgaagtcccagtcgatcgccttttcggggcgcaggttcggattgttgttgacgatcgcgttgttcgagatcgtcccctggaacagctcgccgaccgtcggaaaacgcgtgccggtcgcgaacgacagccggaagcgccacacgtcggtcgcatcccattgcagcgcaactttcggcgacagcgcgttggcgctgcgatccgcatagccgaacgtgccgctcgcgttgccgagcgcgccgccgtaggcgtcccagcgctcgtagcgcagcccgagcgtcgcgagccagcccggcgcgaagcgccatgcgtcctgcgcgtagagcgcctgcgtgcgcgtatcgccgcgatagacgctggcgagcgacgtgaccggaccgttcagccagtcggccgtgttgtatgtgacgttgcgcaggaaatagttgtcgtagtgatagccgaacgtgaacgcatgaccgtgcacctcgggcgcttcggccttcaggtcgagcgtgcgccagccggtgccgtcaccctggaacagcgtgcccgccccgccctgcgcggtagacgcggcgcgcagcacgtcgcgcgacacgtcgtacgccgacacgatgcccgacagccgccagcccgacgcgagccggccgttcagcccgaacgcgtacagccagttctcctggtcgccgcgctgcggcgcgaatgcgccgggcgcgatcgtcaggttctgcccgccgatcgccacgttgccgccatagaccggctggccggccgcgtcgcgcagaaacgtgtcgccgtgctggcggtagtggttctcccaatgcccgagcgtcagcgtcgcgtcgacgcggtcggtgaacgcatagcccatgcgcaccgtttcgttgatctgctcggtgcgctcgagcgattgcgcgccgacgatcgtgcgcgccttgccgttcggcccgatgtcggtggcggcgcccgtgacgggcaccgcgcggccgagtttcgcgttgtagctcgcgttcgggctcgcgtactgcatcggctgaccgtcgttctcgagccggtcgagcgacagcgagaaccagaagcggccgatgcggttcgcgatccgcgcagtctgatgattgccgccgaagctgtcggcgaatccgtagccgtcgcgatagcgctgcgtgaagaactgcgtcgacagcgacgcctcgagcttgtccggccgccgcgtggtcagtagcacggtcgagccgatcgcattgcccggatacagcgccgaaaacgggccgtacagcacgtcgacgcgcgcgatgtcgtcgggcgcgatcagcgaccagcgcggcggatacgcatagctcgaaccgagcaggttcgacaacagcaggccgtccgcatagacgaggccccgcgcgctctgcagctcgttgaagtcgcgccccgcgaacacgctgttgcggtcgccgatatagcgcttgcgcaccatcaggttcggcgcgtacttcagcgtgtcctcggccgtgacgttggtatgcgtgtcgatgcgctcgcgcgtcatcgattcgacgacggccggcgtatcgggatcgagcggctggcgctgggccgtcacgctgacggcgctcagcgtgtcgccggccggttcggcggaagcagccgaagccgcggaagccgcgggcacgacggcccgcgcggagcggttcgcgggatcgcggaccggatcggtcggcgcgctgtcggacgatgccgcatatgcgccgggcaaggcaaaagcggccgcgcacgccagcgcgagccggccgcgcgtcggtcgcgcggcaagggtaagcaacat

SEQ ID NO: 233 - DNA, 2175 bp, Burkholderia multivorans
tcagaacgtcgtgcgcaatccggccatcacgctgcggccgccttgcggcgcgaagccgcgcacgacggaggtcgcgtagcggatgtcctggttcgtcaggttgtcgccgcgcagatacgcgagccagtgcgtcgcgccgacgcggaacttgtacgtcagcaccacgccgagcgaggtatagccggcggtcggttcatcgtcggcgggcacgcgatgctgcgaccacgcgtgcgtgagctgcgcgcgtgcgccgaacggaccgtagccgtaatcggccgcgagcgtcgcgcgcagcggtgcgatgcgcggcagcggctcgccggtgtcgacgttgcgcgcatgcgtatagtcggccgtcaactcgaggtcgaccgtgtggccgctgtgtgcatagacgcgatacttgccgtcgagctcgatgccgtagaactccgcgcgcacgccgcgatagacggcctcggcgagcgcgtcgtcggtgccgcgcgggaccggctcgccgtcgctgtcgacgatgcgcccggtcgcgtattcggccagatagttcgaaaagcggttgtagaacatgccgacgctgccgcgattcggtccgctcgcatagcgcagcgacagatcggtcgacacggccttttccttcgacgcattcggattgccgatcaggtactgcccggtcgcatcgtgcgggccgttcgaatagagctcgtagaacgtgggcgcgcgttcggtgtacgcgacgttcgcggcgatcgaccagacgggcgtcagcgaaaacagcgcgccggccgacacgctgcctgcgttgaacgtgcgcgattgcgcgcccgcgaatttctcgacgccggccggatcgggatcgacgttcacatgctcgatgcgtccgccgaggctcagcttcagcgccggatcgacctgccattcctcgaggccgaatagcgcgacgctattggtgcgcgtcgacggaaccagcgtttcgtcgccgagcgcggagaacgtattgccgccgaactgcacgccgatcgcgccttcgagcggcccaagcttgcggtgccgcgcctcgatgcgcgcctcgtagccgcgattgcggaacgtcgtcgcggtttcgccgttgtcgacttccttgtggcggtaatcggtgtaggcgaagtcgaatttcagcgtcgagaacggccccggcaggttgcgcgcctccgacgcgaaggcgaggcgctcctgacgcatgcgcagccgcacgtcgtcttcggcgaccgacccgtagttcgattcgtagccgctgtacgacaggcccgcgaaaccgtcggcccacgtgtacgacgcgccgaccgcgccgccgtgcacgcggccgtcgctgttcggcacgctgccgaccggctgcggcgtgtcggggccgtcgagcgcgcgttgcgtatcgctgcgcgcatagccgggaatccgcagcttgccggtttcgcgatcgaatgcgtcgacgtggaacgcgaagcggccattgccgccttcgacctgcgcggcgcccgcgcgcgtggcgttcgcgccgccgtagcggacgtcgagcgtaccggtcggaccgtcgatcgcctcgcgcgggatccggttgtcgatcgtgttcacgacgccgccgatcgcgttgccgccgtacagcaacgccgccgggccgcgcacgatctcgacgcgctcgatcgacagcgggtcttccggcacggcatggtcgtacgaaagcgacgacgcatcgtaggcggccacgccgttctgcagcagccggatccggtcgccgtccatgccgcgcacgatcgggcggccgaccatcggcccgtacgtcgtggtcgacacgccgggcaggccgttcagcgtttcgccgagcgaatcggcctggcggcgcagcagcgcatcgcccgacagctgcgcggtgggcgcgatcagttcggcgtcgccgagcggattcgcggtgacgaaaatcggcgcgagcggcgcgccgctcgaggacggcgacgtcgcggttgcgggcgtgtcggtttgcgcatgcgcaagggcggcgagcgccatcagcgaaacgggcgagagcgggcggagcggaagacgagggagacgtggaagacgtgggaggtcgcgcatggtcgaggagtcggttgaagtctgtcggaatcggatcgggggcgagcccggcgcgccgcgaatcggtttcat

SEQ ID NO: 234 - DNA, 1296 bp, Burkholderia multivorans
atgcgcgtcgaacgggttccataccgcttactcactgtcgcgacggccgccgttttcctggccgcgtgcgggaaaaaagaatcggcaccgccgccgcaaacgccggaagtcggcgtcgtcacggtccagccgcaggccgtaccggtcttcaccgaactgcctggccgcaccagcgcgttcctcgtcgcgcaggtccgcgcgcgggtcgacggcatcgtgctgcgccgtgaattcaccgaaggcagcgacgtcaaggccggtcagcgcctctacaagatcgacccggcaccgtatatcgccgcgctgaacagcgcgaaggcgacgctcgcgaaggcgcaggcgaacctcgccacgcagaacgcgctcgtcgcgcgctacaaggtgctggtggccgcgaacgcggtcagcaagcaggactacgacaacgcggtggccgcgcaagggcaggccgccgccgacgtcgcggccggcaaggcgtcggtcgagaccgcgcagatcaacctcggctacacggacgtcgtatcgccgatcaccggccgcgtcggcatctcgcaggtgacgccgggcgcgtacgtgcaggcgagccaggcgacgctgatgtcgaccgtgcagcagctcgacccggtctacgtcgacctcacgcaatcgagcctcgaggggctgaagctgcgtcaggacgtgcagagcggccgtctgaagacgacgggccccggtgccgcgaaggtgtcgctgatcctggaggacggccgcacctattcgcagcccggcaagctgcagttctccgacgtgacggtcgaccagacgaccggctcggtcacgatccgtgcggtgttcccgaacccgggcaaggtcctgctgccggggatgttcgtgcgcgcgcgcatcgaggaaggcgtgaacgacaacgcgtatctggtgccgcagatcggcgtcacgcacgaccagaagggccaggcggtcgcgatggtcgtcaacgcgaacaacaaggtcgagccgcgcacgctgaccgcaacgcgcatcgaaggtcagaactgggtcgtcgaaagcgggctgcagcccggcgatcgcgtgatcgtgcagggtgtcgacaaggtgcgtccgggcgcgaccgtgaaggccgttccggcgcagctcgcgtcggcgccgaacgacgcgtcgggtgccgccgcgccggccgccgccgcaccggcttcggccgccgcggcatcggccgccgcagcatcgagtgccggcgcgtcgggcgcgccggctagcgccgccgcggggtcgtccgccgccgcttcgggcgcgcaataa

What is claimed is:

1. A composition comprising:
   a first isolated polypeptide that is:
     metal regulated in a *Burkholderia* spp., and
     comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
   a second isolated polypeptide having an amino acid sequence different than the amino acid sequence of the first isolated polypeptide, wherein the second isolated polypeptide is:
     metal regulated in a *Burkholderia* spp., and
     comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9; and
   an effective amount of a pharmaceutically-acceptable adjuvant.

2. The composition of claim 1, further comprising a third isolated polypeptide comprising an amino acid sequence having at least 90% sequence similarity to SEQ ID NO:5, SEQ ID NO:6, SEQ ID NO:8, SEQ ID NO:10, SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, or SEQ ID NO:25.

3. The composition of claim 1, further comprising a third polypeptide comprising the amino acid sequence of SEQ ID NO:51, SEQ ID NO:52, SEQ ID NO:53, SEQ ID NO:54, SEQ ID NO:55, SEQ ID NO:56, SEQ ID NO:57, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:69, SEQ ID NO:70, SEQ ID NO:71, SEQ ID NO:72, SEQ ID NO:73, SEQ ID NO:74, SEQ ID NO:75.

4. The composition of claim 1, further comprising a third polypeptide comprising the amino acid sequence of SEQ ID NO:101, SEQ ID NO:102, SEQ ID NO:103, SEQ ID NO:104, SEQ ID NO:105, SEQ ID NO:106, SEQ ID NO:107, SEQ ID NO:108, SEQ ID NO:109, SEQ ID NO:110, SEQ ID NO:111, SEQ ID NO:112, SEQ ID NO:113, SEQ ID NO:114, SEQ ID NO:115, SEQ ID NO:116, SEQ ID NO:117, SEQ ID NO:118, SEQ ID NO:119, SEQ ID NO:120.

5. The composition of claim 1, further comprising a third polypeptide comprising the amino acid sequence of SEQ ID NO:141, SEQ ID NO:142, SEQ ID NO:143, SEQ ID NO:144, SEQ ID NO:145, SEQ ID NO:146, SEQ ID NO:147, SEQ ID NO:148, SEQ ID NO:149, SEQ ID NO:150, SEQ ID NO:151, SEQ ID NO:152, SEQ ID NO:153, SEQ ID NO:154, SEQ ID NO:155, SEQ ID NO:156, SEQ ID NO:157, SEQ ID NO:158, SEQ ID NO:159, SEQ ID NO:160, SEQ ID NO:161, SEQ ID NO:162, SEQ ID NO:163, SEQ ID NO:164.

6. The composition of claim 1, further comprising a third polypeptide comprising the amino acid sequence of SEQ ID NO:189, SEQ ID NO:190, SEQ ID NO:191, SEQ ID NO:192, SEQ ID NO:193, SEQ ID NO:194, SEQ ID NO:195, SEQ ID NO:196, SEQ ID NO:197, SEQ ID NO:198, SEQ ID NO:199, SEQ ID NO:200, SEQ ID NO:201, SEQ ID NO:202, SEQ ID NO:203, SEQ ID NO:204, SEQ ID NO:205, SEQ ID NO:206, SEQ ID NO:207, SEQ ID NO:208, SEQ ID NO:209, SEQ ID NO:210, SEQ ID NO:211.

7. A method comprising:
   administering to a subject an amount of a composition effective to induce the subject to produce antibody that specifically binds to at least one component of the composition, wherein the composition comprises:
   a first isolated polypeptide that is:
      metal regulated in a *Burkholderia* spp., and
      comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
   a second isolated polypeptide having an amino acid sequence different than the amino acid sequence of the first isolated polypeptide, wherein the second isolated polypeptide is:
      metal regulated in a *Burkholderia* spp., and
      comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
   and
   an effective amount of a pharmaceutically-acceptable adjuvant.

8. A method for treating an infection in a subject, the method comprising:
   administering an effective amount of a composition to a subject having or at risk of having an infection caused by a *Burkholderia* spp., wherein the composition comprises:
   a first isolated polypeptide that is:
      metal regulated in a *Burkholderia* spp., and
      comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
   a second isolated polypeptide having an amino acid sequence different than the amino acid sequence of the first isolated polypeptide, wherein the second isolated polypeptide is:
      metal regulated in a *Burkholderia* spp., and
      comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
   and
   an effective amount of a pharmaceutically-acceptable adjuvant.

9. A method for treating a symptom in a subject, the method comprising:
   administering an effective amount of a composition to a subject having or at risk of having an infection caused by a *Burkholderia* spp., wherein the composition comprises:
   a first isolated polypeptide that is:
      metal regulated in a *Burkholderia* spp., and
      comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9,
   a second isolated polypeptide having an amino acid sequence different than the amino acid sequence of the first isolated polypeptide, wherein the second isolated polypeptide is:
      metal regulated in a *Burkholderia* spp., and
      comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
   and
   an effective amount of a pharmaceutically-acceptable adjuvant.

10. A method for decreasing colonization in a subject, the method comprising:
    administering an effective amount of a composition to a subject colonized by a *Burkholderia* spp., wherein the composition comprises:
    a first isolated polypeptide that is:
       metal regulated in a *Burkholderia* spp., and
       comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9,
    a second isolated polypeptide having an amino acid sequence different than the amino acid sequence of the first isolated polypeptide, wherein the second isolated polypeptide is:
       metal regulated in a *Burkholderia* spp., and
       comprises an amino acid sequence having at least 90% sequence similarity to SEQ ID NO:1, SEQ ID NO:2, SEQ ID NO:3, SEQ ID NO:4, SEQ ID NO:7, or SEQ ID NO:9;
    and
    an effective amount of a pharmaceutically-acceptable adjuvant.

\* \* \* \* \*